United States Patent 11,931,406 (FLAVIVIRUS VACCINE) - sequence listing, part 14

SEQ ID NO: 7378 - RNA, 9873 nt, Artificial Sequence
  derived and/or modified CDS sequence (wt) from DENV-3__HM756274__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucacuauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacaggcuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaaugccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguggggguuggaguacagaaagaaggaguuuuccacaccauguggcacgucacaagaggggcaguguugacacacaaugggaaaagacuggaaccaaacugggcuagcgugaaaaaagaucugauuucauacggaggaggauggagauugagcgcacaauggcaaaagggggaggaggugcagguuauugccguagaaccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaucuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguguugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7379 - RNA, 9873 nt, Artificial Sequence
  derived and/or modified CDS sequence (wt) from DENV-3__HM756275__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguugagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacgugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacaggcuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaggcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaauugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcagcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggauaaucuggugaugcugcauacaucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguacccauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguaggacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7380 - RNA, 9873 nt, Artificial Sequence
  derived and/or modified CDS sequence (wt) from DENV-3__JF937632__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggccaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauacugcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggccgaaccuccuuuuggggaaagcaacauagugauuggaauuggagacaacgccuugaaaaucaacugguauaagaagggaagcucuauugggaagauguucgaggccacagccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacauaggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaagagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggacgaagcccauuucacagacccagccaguauagcggcuagaggguacauaucgacucguguuggaaugggagaggcagcggcaauuuucaugacagcaacgcccccuggaacagcugacgccuuuccucagagcaacgcuccaauucaagaugaagaaagggacauaccagaacgcucauggaauucaggcaaugaauggauaaccgacuuugcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcccacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaggcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggcuauuagcggggaugauugcguagugaaaccaaucgaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugccuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7381 - RNA, 9873 nt, Artificial Sequence
  derived and/or modified CDS sequence (wt) from DENV-3__HM756281__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuguaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccaaggagcuaaaauacucauggaaaacguggggaaaggcaaagauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacacacccuuuggaguaauggugugcuagagagugacaugaucaucccaaagagucuagcugguccuauuucgcaacacaaccacaggcccggguaccacacucagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcguugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaauugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagccgcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuagagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucacgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7382 - RNA, 9873 nt, Artificial Sequence
  derived and/or modified CDS sequence (wt) from DENV-3__JF937643__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaaguugagaagguagagacaugggcccuuaggcacccaggguuuaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccauuuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcagggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagaaggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcaggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauagcacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacguuauaacuggcacgucagcagaccucaccguagaaaaagcagcagauauaacaugggaggaagaggcugagcaaacaggagugucccacaacuuaaugaucgcaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacgugccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggccagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcccuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaguaauagcagccaaugaaaugggauugcuagaaacuacaaagagagauuuaggaaugucuaaggagccagguguugucucuccaaccagcuauuuagauguggacuugcauccagcgucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaauauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacucuacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaacgcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaugacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaacuugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7383 - RNA, 9873 nt, Artificial Sequence
  derived and/or modified CDS sequence (wt) from DENV-3__HM181972__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacauuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacauuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacauaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuugguuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagcggcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacggauggaccagagcgggugauccuggcuggaccaaugccagucaccgcggcgagugcugcgcaaaggagagggagaguuggcaggaauccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucggccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuauugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggcuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacucuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaagguuaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccuggggaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7384 - RNA, 9873 nt, Artificial Sequence
  derived and/or modified CDS sequence (wt) from DENV-3__HM631857__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagcuggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacacggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuucauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauugcugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcgauaguccuggaguuuuuuaugaugguguugcuuauaccagaaccagaaaagcagagaaccccccaagacaaccaacucgcauaugucgugauaggcauacuuacacuggcugcaguaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuucuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggagguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaauguggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagccgcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7385 - RNA, 9873 nt, Artificial Sequence
  derived and/or modified CDS sequence (wt) from DENV-3__HM631860__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuguaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccaaggagcuaaaauacucauggaaaacguggggaaaggcaaagauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacacacccuuuggaguaauggugugcuagagagugacaugaucaucccaaagagucuagcugguccuauuucgcaacacaaccacaggcccggguaccacacucagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacguauuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcguugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaauugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucacgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7386 - RNA, 9873 nt, Artificial Sequence
  derived and/or modified CDS sequence (wt) from DENV-3__HM181977__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuguaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccaaggagcuaaaauacucauggaaaacguggggaaaggcaaagauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacacacccuuuggaguaauggugugcuagagagugacaugaucaucccaaagagucuagcugguccuauuucgcaacacaaccacaggcccggguaccacacucagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcguugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaauugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucacgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7387 - RNA, 9873 nt, Artificial Sequence
  derived and/or modified CDS sequence (wt) from DENV-3__HM181978__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacaucccugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugcgugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccucaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccagcgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacuuauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacucuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagagggacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagaggcagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcagaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugacuacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7388 - RNA, 9873 nt, Artificial Sequence
  derived and/or modified CDS sequence (wt) from DENV-3__JN183884__SS-prME
acaucgcucugucucaugaugauauugccagcagcacuugcuuuccacuugaccucacgagauggagagccgcgcaugauuguggggaagaaugaaagaggaaaaucccuacucuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaaaaaugaagaacaaagcauggaugguacauagacaaugguuuuuugaccuaccuuuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuucuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacgacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuacaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggauuauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagggucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuugggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7389 - RNA, 9873 nt, Artificial Sequence
  derived and/or modified CDS sequence (wt) from DENV-3__HQ541785__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaaguugagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcagggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuucaggcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguaccuauggcuggaccauuaguggccgggggcuugcugauagcgugcuacguuauaacuggcacgucagcagaccucaccguagaaaaagcagcagauauaacaugggaggaagaggcugagcaaacaggagugucccacaacuuaaugaucgcaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggccagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauuggacucauuuguguaauuacuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacucuacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggaaaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaugacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaacuugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7390 - RNA, 9873 nt, Artificial Sequence
  derived and/or modified CDS sequence (wt) from DENV-3__HM181975__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcacccaggguucaccauacuagcccuauuucuugcccauuacauaggcacauccuugacccagaaggugguuauuuuuguacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucuccugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaauugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuuguucuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugauuacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauagucuuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugauacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7391 - RNA, 9873 nt, Artificial Sequence
  derived and/or modified CDS sequence (wt) from DENV-3__HM631864__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaaguugagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccauuuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcagggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagaaggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcaggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuccacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacguuauaacuggcacgucagcagaccucaccguagaaaaagcagcagauauaacaugggaggaagaggcugagcaaacaggagugucccacaacuuaaugaucgcaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacgugccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggccagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggaaaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcccuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaguaauagcagccaaugaaaugggauugcuagaaacuacaaagagagauuuaggaaugucuaaggagccagguguugucucuccaaccagcuauuuagauguggacuugcauccagcgucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaauauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacucuacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaacgcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaugacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaacuugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7392 - RNA, 9873 nt, Artificial Sequence
  derived and/or modified CDS sequence (wt) from DENV-3__HM631859__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacgugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaggcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaauugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcagcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuuguaacagaaauaggaagagugccuucacaccuagcccauagaacgagaaacgcucuggacaaucuggugaugcugcauacaucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggagacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7393 - RNA, 9870 nt, Artificial Sequence
  derived and/or modified CDS sequence (wt) from DENV-3__HM631856__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuguaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccaaggagcuaaaauacucauggaaaacguggggaaaggcaaagauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacacacccuuuggaguaauggugugcuagagagugacaugaucaucccaaagagucuagcugguccuauuucgcaacacaaccacaggcccggguaccacacucagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucagaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcguugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaauugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucacgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7394 - RNA, 9873 nt, Artificial Sequence
  derived and/or modified CDS sequence (wt) from DENV-3__HM756276__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuguaaacuggaaaggcaaagaacucaaauguggaaguggaaucuucgucaccaacgagguccauaccuggacagaacaauacaaauuucaagcagacuccccaaaaagauuggcgacagccauugcaggcgcaugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaagauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacacacccuuuggaguaauggugugcuagagagugacaugaucaucccaaagagucuagcugguccuauuucgcaacacaaccacaggcccggguaccacacucagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucaaccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcguugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaauugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacuuuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacucacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggaguugugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucacgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7395 - RNA, 9873 nt, Artificial Sequence
  derived and/or modified CDS sequence (wt) from DENV-3__HM756279__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacacagugauuggaauuggagacaacgccuugaaaaucaacugguauaagaagggaagcucuauugggaagauguucgaggccacugccagaggugcaaggcgcauggccaucuugggagauacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacauuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagccaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaaauuuuugggaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuacagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaccaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7396 - RNA, 9873 nt, Artificial Sequence
  derived and/or modified CDS sequence (wt) from DENV-3__HQ891025__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagcuggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugaaaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucguuaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauucuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuucauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuucuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggagguccaggacaugaagaaccaguaccuauguccacauacggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucaugaauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7397 - RNA, 9873 nt, Artificial Sequence
  derived and/or modified CDS sequence (wt) from DENV-3__HQ705617__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacagucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcucuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacucuccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuagaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggauuauaccagcucucuuugagccagaaagggagaagucagccgccauagacggugaguaucgccugaaaggugaguccaggaagaccuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccggguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7398 - RNA, 9873 nt, Artificial Sequence
  derived and/or modified CDS sequence (wt) from DENV-3__HQ705619__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagcuggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacacuaaccuggaacagaaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucaucacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacggucgucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuucauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuucuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuauaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggagguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7399 - RNA, 9873 nt, Artificial Sequence
  derived and/or modified CDS sequence (wt) from DENV-3__HQ705620__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaacaugagaaccucaaauacaccgucaucauuacagugcauacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagccacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguccugaacucauuaggcaaaauggugcaccaaauauucggaagugcuuacacagcccuauucaguggagucucuuggguaaugaaaauuggaauaggaguucucuugacuuggguaggguugaacucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggcuguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaagacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauagugucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguuuaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacgacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagccaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugcccucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaggaaguuaaaucaauuaucccggaaagacuuugaccuuuacaagaaaucuggaaucacugaaguggauagaacagaagccaaagaaggguugaaaagaggagaaauaacacaucaugccguguccagagguagugcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggacgaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucuguucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7400 - RNA, 9873 nt, Artificial Sequence
  derived and/or modified CDS sequence (wt) from DENV-3__HQ705621__SS-prME
acaucgcucugucucaugaugauauugccagcagcacuugcuuuccacuugaccucacgagacggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcauccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacgugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccauccugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaggcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaauugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccuuuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcagcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacaucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauaggacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaauuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcaccaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagacacaacuccauuuggccagcagagagucuuuaaagagaaaguggacaccaggacacccagguccaugccaggaacaagaagggucauggggaucacagcagaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7401 - RNA, 9873 nt, Artificial Sequence
  derived and/or modified CDS sequence (wt) from DENV-3__HQ671176__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggauguggcuuguuuggcaagggaagcuugguaacaugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuugggaaaauuagagcuggacuucaacuauugugaaggaacaacgguugucauuacagaaaauugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggagcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuuuaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaguaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuacuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugaugaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggggccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggauacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaauugaugacagguucgcuaaugcccuacucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguga

SEQ ID NO: 7402 - RNA, 9873 nt, Artificial Sequence
  derived and/or modified CDS sequence (wt) from DENV-3__HQ705609__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguccucuugacuuggauaggguugaacucaaaaaacacauccaugucauuuucaugcauugcgauaggaaucauuacacucuaucugggagcuguggugcaagcugacaugggguguguuguaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccaaggagcuaaaauacucauggaaaacguggggaaaggcaaagauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacacacccuuuggaguaauggugugcuagagagugacaugaucaucccaaagagucuagcugguccuauuucgcaacacaaccacaggcccggguaccacacucagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcggcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaaaguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcguugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaauugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagccgcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaauaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuagagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucacgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7403 - RNA, 9873 nt, Artificial Sequence
  derived and/or modified CDS sequence (wt) from DENV-3__HQ705610__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauaccauuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuuccucacguuugugcuccuucucucagggcaaauaacauggaaagacauggcgcacacacuaauaaugauuggguccaacgcaucugacaggaugggaaugggcguuaccuaccuagcuuuaauugcaacauuuaaaauucagccauucuuggccuugggauuuuuccuaagaaaacugacauccagagaaaauuuauuguuaggaguugggcuggcuauggcaacaacguuacaacugccagaggacauugaacaaauggcgaauggaaucgcucuggggcucauggcucuuaaacugauaacacaauuugaaacauaccaauuauggacagcauuaaucuccuuaacguguucaaauacgauuucuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacgugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaacuggaagaagagauguucaaaaagcgaaaucuaaccauaauggaucuccauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaauauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaauuuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacacaccauagagaauucuacagcaaauguaucucuggcagcuauagccaaccaggcagugguccugauggguuuggacaaaggauggccaauaucaaagauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacgcgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcaaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguucccuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7404 - RNA, 9873 nt, Artificial Sequence
  derived and/or modified CDS sequence (wt) from DENV-3__HQ705611__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagcuggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuucauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuucuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggagguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaagaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgcgaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7405 - RNA, 9873 nt, Artificial Sequence
  derived and/or modified CDS sequence (wt) from DENV-3__HQ705612__SS-prME
acaucgcucugucucaugaugauauugccagcagcacuugcuuuccacuugaccucacgagauggagagccgcgcaugauuguggggaagaaugaaagagggaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuuaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggauguggcuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucguuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagccaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauacaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacacacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuucccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugacuugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucucaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7406 - RNA, 9873 nt, Artificial Sequence
  derived and/or modified CDS sequence (wt) from DENV-3__HQ705613__SS-prME
acaucgcucugucucaugaugauauugccagcagcacuugcuuuccacuugaccucacgagauggagagccgcgcaugauuguggggaagaaugaaagaggaaaaucccuacucuuuaagacggccucuggaauuaacaugugcacacucauagccauggacuugggagagaugugugaugacacggucacuuacaaaugcccccacaucacugaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacuuaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucucucauagaggugaaaaccugcacauggccaaaaucacauacccuuuggagcaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacgacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuaucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaacgcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggauuauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuuuuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagggucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguauccagacugcuacugaacagguucacgaugacacacagaagaccuaccauugagaaagauguggauuugggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuuuugcucccaccacuuucaugaauugaucaugaaagauggaagaaaguuggugguucccugcagaccccaggacgaacuaauaggaagagcaagaaucucucaaggagcgggauggagccuuaaagaaacugcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7407 - RNA, 9873 nt, Artificial Sequence
  derived and/or modified CDS sequence (wt) from DENV-3__HQ705615__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaaguugagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcagggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuucaggcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugaucuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguaccuauggcuggaccauuaguggccgggggcuugcugauagcgugcuacguuauaacuggcacgucagcagaccucaccguagaaaaagcagcagauauaacaugggaggaagaggcugagcaaacaggagugucccacaacuuaaugaucgcaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggccagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauuggacucauuuguguaauuacuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauaucacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacucuacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggaaaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguuugcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaugacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaacuugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7408 - RNA, 9873 nt, Artificial Sequence
  derived and/or modified CDS sequence (wt) from DENV-3__JF920398__SS-prME
acaucgcucugucucaugaugauauugccagcagcacuugcuuuccacuugaccucacgggauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauaggcaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcuuugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaaugccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauaccauuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuuccucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggccuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacgugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggauguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaacuggaagaagagauguucaaaaagcgaaaucuaaccauaauggaucuccauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuggcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcacgcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaauguccaaggagccagguguugucucuccaaccagcuauuuagauguggacuugcauccagcaucagccuggacauuguacgccguggccacuacaguaauaacaccaauguuaagacacaccauagagaauucuacagcaaauguaucucuggcagcuauagccaaccaggcagugguccugauggguuuggacaaaggauggccaauaucaaagauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaggucaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacgcgacauguuaaugcggaaccagaaacacccaauauggaugucauuggggaaagaauaaaaaggaucaaggaggagcacaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuauguacaagggaagaguuuacaaagaaggucaggacuaacgcagccaugggcgccguuuucacagaggagaaccaaugggacagcgcaaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccucggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguucccuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaccuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7409 - RNA, 9873 nt, Artificial Sequence
  derived and/or modified CDS sequence (wt) from DENV-3__JF920402__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaggcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaauuguggggcaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcagcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacagugggguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7410 - RNA, 9873 nt, Artificial Sequence
  derived and/or modified CDS sequence (wt) from DENV-3__JF937652__SS-prME
acaucgcucugucucaugaugauacugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugauaacacggucacuuacaaaugcccucacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccgucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagcuugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauagcaggcgcuugggagaauggagugugcggaauuaggucaacaaccagaauggagaaucuccuguggaagcaaauagccaaugaacugaacuacauauugugggaaaacaauauuaaacuaacgguaguugugggugauauaauuggggucuuagagcaaggaaaaagaacacuaacaccacaacccauggagcuaaaguacucauggaaaacauggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaacuacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaacuugggaagaaacacaugauugcggggguuuucuucacguuugugcuccuucucucagggcaaauaacauggagagacauggcgcacacacuaauaaugauuggguccaacgcaucugacaggaugggaaugggcgucaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuugaugaucacaguugaugaugauggaacaaugagaauaaaagaugaugagacugagaauauccuaacagugcuuuuaaaaacagcguuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaaaggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuuuuuaauaucagguaaagggauuggaaagacuucaauaggacuuauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacagggaaaagaggaacaggcucacaaggugaaacuuuaggagaaaaauggaaaaagaaguuaaaccaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaaguccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucgcgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaggaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccagagaggcaguggacagguaggaacuuauggucugaauacauucaccaacaugggagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcaucuaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7411 - RNA, 9873 nt, Artificial Sequence
  derived and/or modified CDS sequence (wt) from DENV-3__JF920404__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucacuauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacaggcuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaaugccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaauuauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaacuugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaaggggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagaaccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaaugcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaucuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7412 - RNA, 9873 nt, Artificial Sequence
  derived and/or modified CDS sequence (wt) from DENV-3__JF937641__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucacuauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacaggcuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaaugccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagaaccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacugauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaucuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguguugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7413 - RNA, 9873 nt, Artificial Sequence
  derived and/or modified CDS sequence (wt) from DENV-3__JF920396__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggagcucucuugacuuggauaggguugaacucaaaaaacacauccaugucauuuucaugcauugcgauaggaaucauuacacucuaucugggagcuguggugcaagcugacaugggguguguuguaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaagauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacacacccuuuggaguaauggugugcuagagagugacaugaucaucccaaagagucuagcugguccuauuucgcaacacaaccacaggcccggguaccauacucagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucaaccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcguugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaauugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacuuuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucacgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7414 - RNA, 9873 nt, Artificial Sequence
  derived and/or modified CDS sequence (wt) from DENV-3__JF920406__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucacuauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacaggcuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaaugccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaauuauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuugaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagaaccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaggaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuacaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcggaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaucuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7415 - RNA, 9873 nt, Artificial Sequence
  derived and/or modified CDS sequence (wt) from DENV-3__JF920409__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuuggcccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcaaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcgggggcuuucuucauguuugugcuccuucucucagggcaaauaacauggagagacauggcgcacacacuaauaaugauuggguccaacgcaucugacaggaugggaaugggcgucaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagucugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauuaaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcugaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugacuacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaacuugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7416 - RNA, 9873 nt, Artificial Sequence
  derived and/or modified CDS sequence (wt) from DENV-3__JF920408__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagacugaggccacccaauuggcgacccuaaggaagcuaugcauugaggggaaaauuaccaacauaacaacugacucaagauguccuacccaaggggaagcgacuuugccugaggagcaggaccaaaacuacguguguaagcauacauacguagauagaggcugggggaacggaugugguuuguuuggcaagggaaguuugguaacaugugcgaaauuucaaugccuagaaccaauagagggaaaaguggugcaauaugagaaccucaaauacaccgucauuauuacagugcacacaggagaucaacaccaggugggaaauggaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacagguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuucuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggccaggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagaaaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauugggucuaacgcaucugacaggaugggaaugggcgucaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacgucuaagaacccuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaagacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuggaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggacugcaggcaaaagccacucgugaagcccagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcggggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaggucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaagucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaggaugaccugcacaaugaggaaaagaucacacagcaaauggacccugaacacaggcagcuagcggacgcuauauuuaagcucacauaccaaaacaaaguggucaaaguucaacgaccgacuccaacaggcacgguaauggacaucauaucuaggaaagaccaaagaggcaguggacaggugggaacuuaugguuugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucccaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7417 - RNA, 9873 nt, Artificial Sequence
  derived and/or modified CDS sequence (wt) from DENV-3__JF920397__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacgugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggaucuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaggcucacaauggcagacugauuacagccaacccaguggugacuaagaaggaggagccugucaauauugaggcugaaccuccuuuuggggaaagcaacauagugauuggaauuggagacaacgccuugaaaauuaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaauugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcacacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcagcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacaucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaagaaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagauauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7418 - RNA, 9873 nt, Artificial Sequence
  derived and/or modified CDS sequence (wt) from DENV-3__JN093513__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacguguaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacgugugcgaaauuucaaugccuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaggcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacacaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcagcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacaucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacucuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagagggacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagaggcagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7419 - RNA, 9873 nt, Artificial Sequence
  derived and/or modified CDS sequence (wt) from DENV-3__JF937624__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagcuggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccuuuaccauggacaucaggagcuacaacggagacaccaaccuggaacagaaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuucauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuauaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgagugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauauguugugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuucuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggagguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguauccagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaaggaucauggggaucacagcggaguggcucuggagaacccugggaaggaacaaaaaaccuagguuaugcacaagggaagaauuuacaaagaaggucaggacuaacgcagccaugggcgcuguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7420 - RNA, 9873 nt, Artificial Sequence
  derived and/or modified CDS sequence (wt) from DENV-3__JN000938__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuuaggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacgcgcacccaaaccuggaugucggcugaaggagcuuggaggcaagucgagaagguagagacaugggcccuuaggcacccaggguucaccauacuagcucuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaagaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaagacgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacucuccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccuucagugagaaagaagagaacaugguaaagucuuuagucucagcgggagguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugaucuuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggauuauaccagcucucuuugagccagaaagggagaagucagccgccauagacggugaguaucgccugaaaggugaguccaggaagaccuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcggcagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7421 - RNA, 9873 nt, Artificial Sequence
  derived and/or modified CDS sequence (wt) from DENV-3__JN093515__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuuaccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguagugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaggcucacaauggcagacugauuacagccaacccaguggugacuaagagggaggagccugucaauauugaggcugaaccuccuuuuggggaaagcaacauagugauuggaauuggagacaacgccuugaaaaucaacugguacaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaauugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggagucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccggcuauuguuagagaggcaaucaagagacgcuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcuucuggacaacauuaauacaccagaagggaucauaccagcucucuuugagccagaaagggagaagucagccgccauagacggugaguaucgccuaaaaggugaguccaggaagacuuucguggaacucaugaggaggggugaucuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaaccacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagacccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggauaucauuggggaaagaauaaaaaggaucaaggaggagcacaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuugugaacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7422 - RNA, 9873 nt, Artificial Sequence
  derived and/or modified CDS sequence (wt) from DENV-3__JF937646__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaauaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacgugugcaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacaggcuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaaugccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccguucgugcacacucccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuaugguaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcucuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcucuuaaaaacagcauuacuaauaguaucaggaaucuuuccauacuccauacccgcaacauugcuggucuggcauaccuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccagguacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggucggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggcuacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7423 - RNA, 9873 nt, Artificial Sequence
  derived and/or modified CDS sequence (wt) from DENV-3__JF937633__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacaucccugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugcgugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaaucaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagccggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcgucaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcugcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaaaaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccagcauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguagaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucacccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacucuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagagggacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagaggcagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacacgaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7424 - RNA, 9873 nt, Artificial Sequence
  derived and/or modified CDS sequence (wt) from DENV-3__JF937634__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagauagaggcugggggaacggaugugguuuguuuggcaagggaaguuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuucuguggaagcaaauagucaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggccaggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauugggucuaacgcaucugacaggaugggaaugggcgucaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacccuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuggaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggacugcaggcaaaagccacucgugaagcccagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcggggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaggucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaagucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaggaugaccugcacaaugaggaaaagaucacacagcaaauggacccugaacacaggcagcuagcggacgcuauauuuaagcucacauaccaaaacaaaguggucaaaguucaacgaccgacuccaacaggcacgguaauggacaucauaucuaggaaagaccaaagaggcaguggacaggugggaacuuaugguuugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucccaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7425 - RNA, 9873 nt, Artificial Sequence
  derived and/or modified CDS sequence (wt) from DENV-3__JF937636__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcaacguggguugacguggugcucgagcacggggggugugugacuaccauggcuaagaacaagccaacguuggauauagagcuucagaagaccgaggccacccaauuggcgacccuaaggaagcuaugcauugaggggaaaaucacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaagauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuucaagcagacuccccaaaaagauuggcgacagccauugcaggcgcuugggagaauggagugugcggaauuaggucaacaaccagaauggagaaucuccuguggaagcaaauagccaaugaacugaacuacauauuaugggaaaacaauaucaaacuaacgguaguugugggugauauaauuggcgucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaauggguaucuugugcuuggcaauccucuuugaagaggugaugagaggaaaauuugggaagaaacacaugauugcggggguuuucuucacguuugugcuccuucucucagggcaaauaacguggagagacauggcgcacacacuaauaaugauuggguccaacgcaucugacaggaugggaaugggcguuacuuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguaccuagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaagaaagauuugaucucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaggagacguuuaagaacucuaauuuuggcaccgacaagggugguugcagcugagauggaagaagcguugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccacuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaauugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggacguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguugugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucacgugagaacucuuacaguggaguggaaggagaaggacugcacaagcuaggcuauauauuaagggacauuuccaagauacccggaggagccauguaugcugaugacacagccgguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7426 - RNA, 9873 nt, Artificial Sequence
  derived and/or modified CDS sequence (wt) from DENV-3__JF937626__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagcuggagagcauagacgugacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuucauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauaugacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcacacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucggaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucuggcuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagauccccuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggccuuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaaguuaugcuccugguuuugugugcaguccaacuucuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucguccccgaaggaagagucauagacuugggcuguggaagaggaggcuggucauauuacugugcaggacugaaaaaagucacagaagugcgaggauacacaaaaggagguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7427 - RNA, 9873 nt, Artificial Sequence
  derived and/or modified CDS sequence (wt) from DENV-3__JF937621__SS-prME
acaucgcucugucucaugaugauauugccagcagcacuugcuuuccacuugaccucacgagauggagagccgcgcaugauuguggggaagaaugaaagaggaaaaucccuacucuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaauauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauacugcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagagacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacgacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaaguccuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauuuuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuucauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaagagcagcagauauaacaugggaggaagaggcugagcaaacaggagugucccacaauuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuacaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuacaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggauuauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaagaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagagccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagggucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuugggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaucauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaauaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7428 - RNA, 9873 nt, Artificial Sequence
  derived and/or modified CDS sequence (wt) from DENV-3__JF937623__SS-prME
gcaucgcucugucucaugaugauauugccagcagcacuugcuuuccacuugaccucacgagauggagagccgcgcaugauuguggggaagaaugaaagaggaaaaucccuacuuuuuaagacggccucuggaaucaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagcuggagagcauagacgugacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucauaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggauuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuucauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauaugacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcacacuuggcaaaagcaaacccaaagauccggcguucuaugggacguacccagccccccagagacacagaaagcagaacuggaagaagggaucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggccuuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaaguuaugcuccugguuuugugugcaguccaacuucuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauccccgaaggaagagucauagacuugggcuguggaagaggaggcuggucauauuacugugcaggacugaaaaaagucacagaagugcgaggauacacaaaaggagguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaauaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7429 - RNA, 9873 nt, Artificial Sequence
  derived and/or modified CDS sequence (wt) from DENV-3__JF937637__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacgugugcaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcgucaaccacugaagccaucuugccugaauauggaacccuugggcuagaaugcucaccacggacaggcuuggauuucaaugaaaugaucuugcuaacaaugaagaauaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaaugccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucaucacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagaaagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuucuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugauuuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccgggaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagccgggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagagucauagaccugggcuguggaagaggaggcuggucauauuacugugcaggacugaaaaaagucacagaagugcgaggauacacaaaaggcgguccaggacaugaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguuuacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagauuaugcacaagggaagaauuuacaaagaaggucaggacuaacgcagccaugggcgccguuuucacagaggagaaccaaugggacagcgcgaaagcugcuguugaggaugaggacuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcuguuaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7430 - RNA, 9873 nt, Artificial Sequence
  derived and/or modified CDS sequence (wt) from DENV-3__JF937638__SS-prME
acaucgcucugucuccugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcauacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagccacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguccugaacucauuaggcaaaauggugcaccaaauauuuggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaagacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccggucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguccuaugggacguacccagccccccagagacacagaaagcagaacuggaagaagggguuuauaggaucaaacagcaaggaauuuuuggaaaaacccaaguaggaguuggaguacagaaagaaggagucuuccacaccauguggcacguuacaagaggggcagugcugacauacaaugggaaaagacuggaaccaaacugggcuagcgugaaaaaagaucugauuucauacggaggaggauggagauugagcgcacaauggcaaaaaggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugcccucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauuccacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugacucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaggaaguuaaaucaauuaucccggaaagacuuugaccuuuacaagaaaucuggaaucacugaaguggauagaacagaagccaaagaaggguugaaaagaggagaaauaacacaucaugccguguccagagguagugcaaaacuucaaugguuuguggagagaaacauggucacucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacuuaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccagauaaucagacaaauggaaggagaaggugugcugucaaaggcagaccucgagaacccucaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcaggccccaggacgaacuaauaggaagggcaagaaucucucaaggagcgggauggagccuuaaagagaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7431 - RNA, 9873 nt, Artificial Sequence
  derived and/or modified CDS sequence (wt) from DENV-3__JF937639__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagaaggagcaaugcauaccgcuuugacaggagccacagaaauccaaaacucaggaggcacaaguauuuuugcggggcacuuaaaaugcagacuuaagauggacaaguuggaacucaaggggaugaguuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucuaaacucauuaggcaaaauggugcaccaaauauucggaagugcuuacacagcccuauucaguggagucucuuggguaaugaaaauuggaauaggaguucucuugacuuggauaggguugaacucaagaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacgaccaacauauggcugaaacuccgagaggcguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauaccauuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuuccucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggccuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacgugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaaccaaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaacuggaagaagagauguucaaaaagcgaaaucuaaccauaauggaucuccauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaagacggugugguuuguccccagcauuaaggcuggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacacaccauagagaacucuacagcaaauguaucucuggcagcuauagccaaccaggcagugguccugauggguuuggacaaaggauggccaauaucaaagauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacgcgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcaaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaagguguguugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguucccuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucuuauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7432 - RNA, 9873 nt, Artificial Sequence
  derived and/or modified CDS sequence (wt) from DENV-3__JF937627__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaaaguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuuaccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguagugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaggcucacaauggcagacugauuacagccaacccaguggugacuaagagggaggagccugucaauauugaggcugaaccuccuuuuggggaaagcaacauagugauuggaauuggagacaacgccuugaaaaucaacugguacaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaauugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggagucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccacccugauuuuggccggaguuucgcuuuuaccaaugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauugcuaauaguaucaggaaucuuuccauacuccauacccgcaacauugcuggucuggcauacuuggcaaaagcaaacccaaagauccggcguucuaugggacguacccagcccuccagagacacagaaggcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccggcuauuguuagagaggcaaucaagagacgcuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcuucuggacaacauuaauacaccagaagggaucauaccagcucucuuugagccagaaagggagaagucagccgccauagacggugaguaucgccuaaaaggugaguccaggaagacuuucguggaacucaugaggaggggugaucuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaaccacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagacccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggcgaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggauaucauuggggaaagaauaaaaaggaucaaggaggagcacaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuugugaacaaagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7433 - RNA, 9873 nt, Artificial Sequence
  derived and/or modified CDS sequence (wt) from DENV-3__KF973476__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacgggggaugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcauacaggagaucaacaccaggugggaaaugaaacgcagggagucacggcugagauaacaccucaggcaucaaccacugaagccaucuugccugaauauggaacccuugggcuagaauguucaccacggacagguuuggauuucaaugaaaugaucuugcuaacaaugaagaacaaagcauggaugguacauagacaaugguuuuuugaccuaccuuuaccauggacaucaggagccacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguccugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaauauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacauaggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauucaaaauucagccauucuuggcuuugggauuuuuccuaagaagacugacauccagagaaaauuuauuguuaggaguugggcuggcuauggcaacaacguuacaacugccagaagacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcaugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaagaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagaggaggaaagguagugggacuguaugguaauggagugguuacaaagaaugguggcuaugucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaagcaaucacgagacgguuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaaugcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcggaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccguagacggugaguaucgccuaaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugcccucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuggcaggagcugggcuugcuuuuuccauuaugaaaucaguaggaacaggaaaaagaggaacaggcucacaaggugaaacuuuaggagaaaaauggaaaaggaaguuaaaucaauuaucccggaaagacuuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcaucaaaguguugaacccuuacaugccaacugugauugagcaccuagaaagacuacaaaggaaacauggaggaaugcuugugagaaauccacuuucacgaaacuccacgcacgaaauguacuggauauccaauggcacaggcaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuauguacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccuuaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcccaaauguggagucucauguauuuucacagaagagaccucagacuagcauccaacgccauauguucagcagugccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaagaggagucggagggagccauuugguga

SEQ ID NO: 7434 - RNA, 9873 nt, Artificial Sequence
  derived and/or modified CDS sequence (wt) from DENV-3__KF973478__SS-prME
acaucgcucugucucaugaugauauugccagcagcacuugcuuuccaccugaccucacgagauggagagccgcgcaugauuguggggaagaaugaaagagggaaaucccuacuuuuuaagacggccucuggaaucaacaugugcacacucauagccauggacuugggagagaugugugaugacacggucacuuacaaaugcccccacaucaccgaaguggaaccugaggacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaaaaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggauguggcuuguuuggcaagggaagcuugguaacaugugcgaaauuucaaugcuuagaaccaauagagggaaaaguggugcaacaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugcccugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaucacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaaugguguccuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacgagaggcccaucguuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucaggacaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagccaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacucuauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaauggcggcuacgucagcggaauagcgcaaacgaacgcagaaccagauggaccgacaccagaauuggaagaagagauguuuaaaaaacgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcugcuggacaacaucaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcggggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggacagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaggcuaggcuauauauuaagggacauuuccaagauacccggaggagccauguaugcugaugacacagcugguugggacacaagaauaacagaagaugacuugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuugagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauauuuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7435 - RNA, 9873 nt, Artificial Sequence
  derived and/or modified CDS sequence (wt) from DENV-3__KF973479__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagauauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucucgcccauuacauaggcacaucccugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugcgugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaaacaagaaguaguuguccuuggaucgcaagagggagcaaugcauaccgcacugacaggagccacagaaauucaaaacuuaggaggcacaaguauuuuugcggggcacuuaaaaugcagacuuaagauggacaaauuggagcucaaggggaugaguuaugcaaugugcacgaauaccuuuguguugaagaaagaagucucagaaacgcagcaugggacaauacucauuaaggucgaguacaaaggggaagaugcgccuugcaagauuccuuucucaacagaggauggacaagggaaagcucauaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacuaaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacugacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacaaggggcccaucauuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccagcgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcccuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauugcuaauaguaucaggaaucuuuccauacuccauacccgcaacauugcuggucuggcauacuuggcaaaagcaaacccaaagauccggcguucuaugggacgugcccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuaguguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacuuuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacguucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacccuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacucuuguuaaugagaacaucaugggccuugugugaagcuuuaacucuagccacaggaccaauaacaacacucugggaaggaucaccugggaaguuuuggaacaccacgauagcuguuuccauggcgaacauuuucagagggagcuauuuagcaggagcugggcuugcuuuuuccauuaugaaaucaguaggaacaggaaaaagagggacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguugaaaagaggagaaauaacacaucaugccguguccagaggcagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaaccauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggucagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauuaggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaauucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaggaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7436 - RNA, 9873 nt, Artificial Sequence
  derived and/or modified CDS sequence (wt) from DENV-3__KF973480__SS-prME
acaucgcucugucucaugaugauauugccagcagcacuugcuuuccaccugaccucacgagauggagagccgcgcaugauuguggggaagaaugaaagagggaaaucccuacuuuuuaagacggccucuggaaucaacaugugcacacucauagccauggacuugggagagaugugugaugacacggucacuuacaaaugcccccacaucaccgaaguggaaccugaggacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuacacuacuaaugcuggucaccccauccaugacaaugagaugugugggaguaggaaacagagauuuuguggaaggucuaucaggagcuacguggguugacguggugcucgagcacggggggugugugacuaccauggcuaaaaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggauguggcuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaagcaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauauucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacguccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaaugguguccuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacgagaggcccaucguuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugcgcuccuucucucaggacaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagccaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggagugcagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaauggcggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuaaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcugcuggacaacaucaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacagacaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggacagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugcgacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugacuugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuugagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7437 - RNA, 9873 nt, Artificial Sequence
  derived and/or modified CDS sequence (wt) from DENV-3__KF973481__SS-prME
acaucgcucugucucaugaugauauugccagcagcacuugcuuuccaccugaccucacgagauggagagccgcgcaugauuguggggaagaaugaaagagggaaaucccuacuuuuuaagacggccucuggaaucaacaugugcacacucauagccauggacuugggagagaugugugaugacacggucacuuacaaaugcccccacaucaccgaaguggaaccugaggacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaaaaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggauguggcuuguuuggcaagggaagcuugguaacaugugcgaaauuucaaugccuagaaccaauagagggaaaaguggugcaauaugagaaccucaaauacaccaucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcucaugcgaagaagcaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccguuaaggaugagagggccguacaugccgacaugggcuauuggauagaaagccaaaagaauggaaguuggaagcuggaaaaagcaucccucauagaggugaaaaccugcacauggccaaaaucacauacccuuuggaguaaugguguccuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugcgggacgagaggcccaucguuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacagugggugucuugugcuuggcaauccucuuugaagaggugaugagaggaaaauuugggaagaaacacaugauugcggggguuuucuucacguuugugcuccuucucucaggacaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagccaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaaccggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaauggcggcuacgucagcggaauagcgcaaacgaacgcagaaccagauggaccgacaccagaauuggaagaagagauguucaaaaagcgaaaucuaaccauaauggaucuucauccugggucagggaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaaugcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcugcuggacaacaucaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggacagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugacuugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuugagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7438 - RNA, 9873 nt, Artificial Sequence
  derived and/or modified CDS sequence (wt) from DENV-3__KF973482__SS-prME
acaucgcucugucucaugaugauauugccagcagcacuugcuuuccaccugaccucacgagauggagagccgcgcaugauuguggggaagaaugaaagagggaaaucccuacuuuuuaagacggccucuggaaucaacaugugcacacucauagccauggacuugggagagaugugugaugacacggucacuuacaaaugcccccacaucaccgaaguggaaccugaggacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaaaaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggauguggcuuguuuggcaagggaagcuugguaacaugugcgaaauuucaaugccuagaaccaauagagggaaaaguggugcaauaugagaaccucaaauacaccaucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaauagaaaggagcuucuugugacauucaaaaacgcucaugcgaagaagcaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccguuaaggaugagagggccguacaugccgacaugggcuauuggauagaaagccaaaagaauggaaguuggaagcuggaaaaagcaucccucauagaggugaaaaccugcacauggccaaaaucacauacccuuuggaguaaugguguccuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugcgggacgagaggcccaucguuaagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacagugggugucuugugcuuggcaauccucuuugaagaggugaugagaggaaaauuugggaagaaacacaugauugcggggguuuucuucacguuugugcuccuucucucaggacaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagccaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaaccggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaauggcggcuacgucagcggaauagcgcaaacgaacgcagaaccagauggaccgacaccagaauuggaagaagagauguucaaaaagcgaaaucuaaccauaauggaucuucauccugggucagggaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaaugcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcugcuggacaacaucaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggacagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugacaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugacuugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuugagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcucagaacauacccacagcaauucaacaggugagaagccuuauaggcaaugaagaguuucuggacuacaugccuucaaugaagagauuuaggaaggaggaggagucggagggagccauuugguaa

SEQ ID NO: 7439 - RNA, 9873 nt, Artificial Sequence
  derived and/or modified CDS sequence (wt) from DENV-3__KF973483__SS-prME
acaucgcucugucucaugaugauauugccagcagcacuugcuuuccacuugaccucacgagauggagagccgcguaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgauaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggaugugguuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacagaaaggagcuucuugugacauucaaaaacgcacaugcgaagaaacaagaaguaguuguccuuggaucgcaagagggagcaaugcauaccgcuuugacaggagccacagaaauccaaaacucaggaggcacaaguauuuuugcggggcacuuaaaaugcagacuuaagauggacaaguuggaacucaaggggaugaguuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucuaaacucauuaggcaaaauggugcaccaaauauucggaagugcuuacacagcccuauucaguggagucucuuggguaaugaaaauuggaauaggaguucucuugacuuggauaggguugaacucaagaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauuguaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacgccggaguguccaagugucucaagagcauggaaugugugggagguggaagauuacggguucggagucuucacaaccaacauauggcugaaacuccgagagacguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauaccauuuggagcaauggugugcuagagagugacaugaucaucccaaagagucuagcugguccuauuucgcaacacaaccacaggcccggguaccacacccagacggcgggaccauggcauuuaggaaaacuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuuccucacguuugugcuccuucucucagggcaaauaacauggagagacauggcgcacacacuaauaaugauuggguccaacgcaucugacaggaugggaaugggcguaaccuaccuagcuuuaauugcaacauuuaaaauucagccauucuuggccuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacgugggaggaagaggcugagcaaacaggagugucccacaauuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggaguggucacaaagaaugguggcuacgucagcggaauagcgcaaacgaacgcagaaccagauggaccgacaccagaacuggaagaagagauguucaaaaagcgaaaucuaaccauaauggaucuccauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaacugacuucgcugggaaaacggugugguuuguccccagcauuaaggcuggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauuuacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaauuuggacaaaggaaggagaaaagaaaaaacugagaccuagguggcuugaugcccgcacuuauucagaucccuuagcacucaaagaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugauccuguugacagguggagcaaugcuuuucuuaauaucagguaaagggauuggaaagacuucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacacaccauagagaauucuacagcaaauguaucucuggcagcuauagccaaccaggcagugguccugauggguuuggacaaaggauggccgauaucaaagauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggauagaacagaagccaaagaaggguuaaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacgcgacauguuaaugcggaaccagaaacacccaauauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcaaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcagcuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaagguguguugucaaaggcagaccucgagaacccucaucugccagagaagaaaauuacacaaugguuggaaaccaaaggaguggagagguuaaaaagaauggccauuagcggggacgauugcguagugaaaccaaucgaugacagguucgcuaaugcccugcucgcucugaacgauaugggaaaaguucggaaagacauaccucaauggcagccaucaaagggauggcaugauuggcaacagguucccuucugcucccaccacuuucaugaauugaucaugaaagauggaagaaagcuggugguucccugcagaccccaggacgaacuaauaggaagagcaagaaucucucaaggagcgggauggagccuuaaagaaaccgcaugucuggggaaagccuacgcucaaauguggagucuuauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuauaugccuucaaugaagagauuuaggaaggaggaggagucggagggagccauuugguaa

SEQ ID NO: 7440 - RNA, 9873 nt, Artificial Sequence
  derived and/or modified CDS sequence (wt) from DENV-3__KF973485__SS-prME
acaucgcucugucucaugaugauauugccagcagcacuugcuuuccacuugaccucacgagauggagagccgcgcaugauuguggggaagaaugaaagaggaaaaucccuacuuuuuaagacggccucuggaauuaacaugugcacacucauagccauggacuugggagagaugugugaugacacggucacuuacaaaugcccccacaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacgugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauagaggggaaaauuacuaacauaacaacugacucaagauguccuacccaaggggaagcgacuuugccugaggagcaggaccaaaacuacguguguaagcauacauacguagauagaggcugggggaacggaugugguuuguuuggcaagggaaguuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacagaaacaccaaccuggaacaaaaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuucuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagaggugcacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaauggugugcuagagagugacaugaucaucccaaagagucuagcugguccuauuucgcaacacaaccacaggccaggguaccacacccagacggcgggaccauggcauuuaggaaaauuagagcuggacuucaacuauugugaaggaacaacgguugucauuacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaaguccuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauugggucuaacgcaucugacaggaugggaaugggcgucaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacgguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacgggagugucccacaacuuaaugaucacaguugaugaugauggaacaaugagaauaaaagaugaugagacugagaauauccuaacagugcuuuuaaaaacagcauuacuaauagugucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcgugaaaaaagaucugauuucauacggaggaggauggagauugagcgcacaauggaaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacccuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauugcaaacugcuugcgaaaaaacgggaaaaaggucauucaacuuaguaggaagacuuuugacacagaauaucagaaaaccaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccguggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuggaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaacaccccaagacaaccaacucgcauaugucgugauaggcauacucacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggaguaccccuacuggcauuggguugcuauucacaagugaacccacuaacucuaacagcggcaguacucuugcugaucacacauuaugcuauuauagguccaggacugcaggcaaaagccacucgugaagcccagaaaaggacagcugcuggaauaaugaagaauccaacgguggaugggauaaugacaauagaccuagauccuguaauauaugauucaaaauuugaaaagcaacugggacagguuaugcuccugguuuuguguguaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaacuaucccggaaagacuuugaccuuuacaagaaaucuggaaucacugaaguggauaggacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcggggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaggucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauauggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaauuuacaaagaaagucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaggaugaccugcacaaugaggaaaagaucacacagcaaauggacccugaacacaggcagcuagcggacgcuauauuuaagcucacauaccaaaacaaaguggucaaaguucaacgaccgacuccaacaggcacgguaauggacaucauaucuaggaaagaccaaagaggcaguggacaggugggaacuuaugguuugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguggugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucccaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcacaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7441 - RNA, 9873 nt, Artificial Sequence
  derived and/or modified CDS sequence (wt) from DENV-3__KF973486__SS-prME
acaucgcucugucucaugaugauauugccagcagcacuugcuuuccaccugaccucacgagauggagagccgcgcaugauuguggggaagaaugaaagagggaaaucccuacuuuuuaagacggccucuggaaucaacaugugcacacucauagccauggacuugggagagaugugugaugacacggucacuuacaaaugcccccacaucaccgaaguggaaccugaggacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaaaaacaagccaacguuggauauagagcuucagaagaccgaggccacccaauuggcgacccuaaggaagcuaugcauugaggggaaaauuacuaacauaacaacugacucaagauguccuacccaaggggaagcgacuuugccugaggagcaggaccaaaacuacguguguaagcauacauacguagacagaggcugggggaacggauguggcuuguuuggcaagggaagcuugguaacaugugcgaaauuucaaugccuagaaccaauagagggaaaaguggugcaauaugagaaccucaaauacaccgucaucauuacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacagaaaggagcuucuugugacauucaaaaacgcacaugcgaagaagcaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugaguuaugcaaugugcacgaauaccuuuguguugaagaaagaagucucagaaacgcagcaugggacaauacucauuaaggucgaguacaaaggggaagaugugccuugcaagauuccuuucuccacagaggauggacaagggaaagcucacaauggcagacugauuacagccaacccaguggugaccaagaaggaggagccugucaauauugaggcugaaccuccuuuuggggaaagcaacauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaacuaacgguaguugugggugauauaauuggggucuuagagcaaggaaaaagaacacuaacaccacaacccauggagcuaaaguacucauggaaaacguggggaaaggcaaaaauagugacagcugaaacacaaaauuccucuuucauaauagacgggccaaacacaccggaguguccaagugucucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuggaaaaagcaucccucauagaggugaaaaccugcacauggccaaaaucacauacccuuuggaguaaugguguccuagagagugacaugaucaucccaaagagucuagcugguccuauuucgcaacacaaccacaggcccggguaccacacccagacggcgggaccauggcauuuaggaaaauuagagcuggacuucaacuauugugaaggaacaacgguugucauuacagaaaacugugggacgagaggcccaucguuaagaacaacaacagugucagggaaguuaauacacgaaugguguugccgcucgugcacgcuuccucccuugcgauacaugggagaagacgguugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucaggacaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacgauuuuuacguugacuguugccuggagaacagccacccugauuuuggccggaguuucgcuuuuaccagugugccagucuucgagcaugaggaaaacagacuggcuuccaauggcaguggcagccaugggaguuccaccucuaccacuuuuuauuuuuggcuugaaagacacacucaaaaggagaagcuggccacugaaugaaggggugauggcuguugggcuugugagcauucuggccaguucucuccuuagaaaugauguaccuauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuuaaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguaggaguuggaguacagaaagaaggagucuuccacaccauguggcacguuacaagaggggcaguguugacauacaaugggaaaagacuggaaccaaacugggcuagcguaaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaauggcggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuagggucccaaacuauaacuugauaauaauggaugaagcccauuucacagacccagccaguauagcggcuagaggguacauaucgacucguguuggaaugggagaggcagccgcaauuuucaugacagcaacgcccccuggaacagcugacgccuuuccucagagcaacgcuccaauucaagaugaagaaagggacauaccagaacgcucauggaauucaggcaaugaauggauaaccgacuucgcugggaaaacggugugguuuguccccagcauuaaggccggaaaugacauagcaaacugcuugcgaaaaaacgggaaaaaggucauucaacuuaguaggaagacuuuugacacagaauaucagaaaaccaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcugcuggacaacaucaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggaauuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaguggaucgcgucggcaauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuagaaacuacaaagagagauuuaggaaugucuaaggagccagguguugucucuccaaccagcuauuuagauguggacuugcauccagcaucagccuggacauuguacgccguggccacuacaguaauaacaccaauguuaagacauaccauagagaauucuacagcaaauguaucucuggcagcuauagccaaccaggcagugguccugaugggucuggacaaaggauggccaauaucaaaaauggacuuaggagcaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagacuuugaccuuuacaagaaaucuggaaucacugaaguggacagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacaccuuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacaucgucgcuucagucaauaugguaucuagacugcuacugaacagguucacgaugacacacagaagaccuaccauugagaaagauguggauuuaggagcaggaacucgacauguuaaugcggaaccagaaacacccaauauggaugucauuggggaaaggauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaagggucauggggaucacagcggaguggcucuggagaacccugggaaggaacaagaaaccuagguuaugcacaagggaagaauuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacauguggcugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugacuugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuugagaacccucaucugccagagaagaaaauuacacaaugguuggaaaccaaaggaguggagagguuaaaaagaauggccauuagcggggaugauugcguagugaaaccaaucgaugacagguucgcuaaugcccugcuugcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuaaagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7442 - RNA, 9873 nt, Artificial Sequence
  derived and/or modified CDS sequence (wt) from DENV-3__FJ898458__SS-prME
acaucgcucugucucaugaugauauugccagcagcacuugcuuuccacuugacuucacgagauggagagccgcgcaugauuguggggaagaaugaaagaggaaaaacccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcauacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggagguacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauucaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaaugacaguggcagcuaugggaguuccaccucuaccacuuuuuauuuucagcuugaaagacacacucaaaaggagaagcuggccacugaaugaaggggugauggcuguugggcuugugagcauucuggcuaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggaaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacaucaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaagaaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacauaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7443 - RNA, 9873 nt, Artificial Sequence
  derived and/or modified CDS sequence (wt) from DENV-3__KJ189256__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcauacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggagguacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauaccuggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7444 - RNA, 9873 nt, Artificial Sequence
  derived and/or modified CDS sequence (wt) from DENV-3__KJ189257__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcaucgaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcauacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggagguacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacacaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagggagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugucacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguagaaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacauucguggaacucaugaggaggggugaccuuccagucugguuagcccacaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguuauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuggaaacuacaaagagagacuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguauucuugcugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguauugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccuuacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauuaggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggauacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7445 - RNA, 9873 nt, Artificial Sequence
  derived and/or modified CDS sequence (wt) from DENV-3__KJ189262__SS-prME
acaucgcucugucucaugaugauauugccagcagcacuugcuuuucacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccacuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcauacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcauuuaaaaugcagacuuaagauggacaaauuggaacucaaggggaugagcuaugcaaugugcacgaauaccuuuguguugaagaaagaagucucagaaacgcagcaugggacaauacucauuaagguugaguacaaaggggaagauguaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggauuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacggugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggagucuuccacaccauguggcacguuacaaggggggcaguguugacauauaaugggaaaagacuggaaccaaacugggcuagcgugaaaaaagaucugauuucauacggaggaggauggagauugagcgcacaauggcaaaagggagaggaggugcagguuauugccauagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaauuaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagcagcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggagaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacagugauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaacccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuaucaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaagcuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaaggagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagacgaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagagggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucucaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7446 - RNA, 9873 nt, Artificial Sequence
  derived and/or modified CDS sequence (wt) from DENV-3__KJ189263__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugucuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaguacucauuaaggucgaguacaaaggggaagauguaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggagucuuccacaccauguggcacguuacaagaggggcaguguugacauauaaugggaaaagacuagaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacagggagagagauuguugaucugaugugccacgcaacguucacaaugcgucugcugucaccaguuaggguuccaaacuauaaccugauaauaauggaugaagcccauuucacagacccagccaguauagcggcuagaggguauauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacaguggaugggauaaugacaauagaccuagauccuguaauauaugauucaaaauuugaaaagcaacugggacagguuaugcuccugguuuugugugcaguccaacuuuuguugaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuuggguuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7447 - RNA, 9873 nt, Artificial Sequence
  derived and/or modified CDS sequence (wt) from DENV-3__KJ189265__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacgcuggauauagagcuucagaagaccgaggccacccaauuggcgacccuaaggaagcuaugcaucgaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcauacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggagguacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaagguugaguacaaaggggaagauguaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcauggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuauggguucggagucuucacaaccaacauauggcugaaacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggcgucuuguguuuggcaauccucuuugaagaggugaugagaggaaaauuugggaagaaacacaugauugcggggguuuucuuuacguuugugcuccuucucucagggcaaauaacauggagagacauggcgcacacacuaauaaugauuggguccaacacaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgaguaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcaaauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcacacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggauccccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugucacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguagaaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguuauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacacuggcugcaauaauagcagccaaugaaaugggauugcuggaaacuacaaagagagacuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguauugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauuaggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggauacaagaauaacagaagaugaccugcacaaugaggaaaagaucacacagcaaauggacccugaacacaggcaguuagcgaacgcuauauuuaagcucacauaccaaaacaaaguagucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggagaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7448 - RNA, 9873 nt, Artificial Sequence
  derived and/or modified CDS sequence (wt) from DENV-3__KJ189266__SS-prME
acaucgcucugucucaugaugauauugccagcagcacuugcuuuucacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccacuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcauacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaagguugaguacaaaggggaagauguaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggauuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuagggaaauuagagcuggacuucaacuauugugagggaacaacaguugucaucacagaaaacugugggacaagaggcccaucauugagaacaacaacggugucagggaaguuaauacacgaaugguguugccgcucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuugacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggagucuuccacaccauguggcacguuacaaggggggcaguguugacauauaaugggaaaagacuggaaccaaacugggcuagcgugaaaaaagaucugauuucauacggaggaggauggagauugagcgcacaauggcaaaagggagaggaggugcagguuauugccauagagccugggaagaacccaaagaacuuucaagccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaauuaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguuuacaaugcgucugcugucaccaguuaggguuccaaacuauaaccugauaauaauggaugaagcccauuucacagacccagccaguauagcggcuagaggguacauaucgacucguguuggaaugggagaggcagcagcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggagaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaaucuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacagugauaacaccaauguuaagacauaccauagagaauucuacagcaaaugugucucuggcagcuauagccaaccaggcagugguccugaugggucuggacaaaggauggccaauaucaaaaauggacuuaggaguaccccuacuggcauuggguuguuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuaucaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaagcuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaaggagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagacgaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaucaaagaggcaguggacagguaggaacuuauggucugaauacauucaccaacauggaagcccaguuaaucagacaaauggaaggagagggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucucaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacugggucccuacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7449 - RNA, 9873 nt, Artificial Sequence
  derived and/or modified CDS sequence (wt) from DENV-3__KJ189268__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcgcuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguuuuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugacgaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgaaaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaacaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaagguuggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaagcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7450 - RNA, 9873 nt, Artificial Sequence
  derived and/or modified CDS sequence (wt) from DENV-3__KJ189271__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcugguguaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaaguugagaagguagagacaugggcccuuaggcacccaggauucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucaaaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaacuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacaucuagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccuuuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuuuguggugacaacugacauuucagaaaugggggccaauuucaaagcugacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauaggaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaauauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagcuacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuuuugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7451 - RNA, 9873 nt, Artificial Sequence
  derived and/or modified CDS sequence (wt) from DENV-3__KJ189272__SS-prME
acaucgcucugucucaugaugauauugccagcagcacuugcguuccacuugacuucacgagauggagagccgcgcaugauuguggggaagaaugaaagaggaaaaucccuacuuuucaagacagccucuggaauuaacaugugcacacucauagccauggacuugggagagaugugugaugacacggucacuuacaaaugccccuacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaguauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaucauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucauuacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacgcuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugacgauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccuggaaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgccucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacgcagauggcaaugacagacacaacuccauuuggccagcaaagagucuuuaaagagaaaguagacaccaggacacccagguccaugccaggaacaagaagggucauggggaucacagcggaguggcucuggagaacccugggaaggaacaaaaaacccagguuaugcacaagggaagaguucacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcagcagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugacuugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgacgacagguucgcuaaugcccugcucgcucugaacgauaugggaaagguucgaaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7452 - RNA, 9873 nt, Artificial Sequence
  derived and/or modified CDS sequence (wt) from DENV-3__KJ189273__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagucaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaacaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaauugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggaguuuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuucagcuugaaagacacacucaaaaggaggagcuggccacugaacgaaggggugauggcuguugggcuugugagcauucuggccaguucucuccuuagaaaugauguacccauggcuggaccauuaguggccgggggauugcugauagcgugcuacgucauaacugguacgucagcagaccucaccguagaaaaagcagcagacauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguuuuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuuuguggugacaacugacauuucagaaaugggggccaacuucaaagcugacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuacgccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaauauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagcuacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaaugcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauuguguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaggacaugcuuacugucuggaacaggguauggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7453 - RNA, 9873 nt, Artificial Sequence
  derived and/or modified CDS sequence (wt) from DENV-3__KJ189274__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccuacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagcuaccuugccugaauauggaacccuuggguuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacaggaaggagcuucuugugacauucaaaaacgcacaugcgaagaaacaagaaguaguuguccuuggaucgcaggagggagcaaugcauacugcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaacggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaagaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggaguuuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuucagcuugaaagacacacucaaaaggaggagcuggccacugaacgaaggggugauggcuguugggcuugugagcauucuggccaguucucuccuuagaaaugauguacccauggcuggaccauuaguggccgggggauugcugauagcgugcuacgucauaacugguacgucagcagaccucaccguagaaaaagcagcagacauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguuuuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagccauagccaaccaggcagugguccugauggguuuggacaaagguuggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucagggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuccuggacuacaugccuucaaugaagagauuuaggaaggaggaggagucggagggagccauuugguaa

SEQ ID NO: 7454 - RNA, 9873 nt, Artificial Sequence
  derived and/or modified CDS sequence (wt) from DENV-3__KJ189275__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccuacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagcuaccuugccugaauauggaacccuuggguuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacaggaaggagcuucuugugacauucaaaaacgcacaugcgaagaaacaagaaguaguuguccuuggaucgcaggagggagcaaugcauacugcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaacggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaagaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaacuagagcuggacuucaacuauugugaaggaacaacaguugucaucacagaaaacugugggacaagaggcccaucauugagaacaacaacagugucagggaagcuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcgaauggaauugcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguuuuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagccauagccaaccaggcagugguccugauggguuuggacaaagguuggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucagggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuccuggacuacaugccuucaaugaagagauuuaggaaggaggaggagucggagggagccauuugguaa

SEQ ID NO: 7455 - RNA, 9873 nt, Artificial Sequence
  derived and/or modified CDS sequence (wt) from DENV-3__KJ189276__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaaaagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacaucuuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuacaaugcucaccacggacagguuuggauuucaaugaaaugaucuugcuaacaaugaagaacaaagcauggaugguacauagacaaugguuuuuugaccuacccuuaccauggacaucaggagcuacaucggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaacuagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaacuagagcuggacuucaacuauugugaaggaacaacaguugucaucacagaaaacugugggacaagaggcccaucauugagaacaacaacagugucagggaagcuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcgaauggaauugcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguuuuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucuuaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaagagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaagguuggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacugcaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaauggaacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcgguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7456 - RNA, 9873 nt, Artificial Sequence
  derived and/or modified CDS sequence (wt) from DENV-3__KJ189277__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaaaagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacaucuuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuacaaugcucaccacggacagguuuggauuucaaugaaaugaucuugcuaacaaugaagaacaaagcauggaugguacauagacaaugguuuuuugaccuacccuuaccauggacaucaggagcuacaucggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaacuagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagaggcguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaagcugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguucagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucuuaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaagagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaagguuggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacugcaaaggaaacauggaggaaugcuugugagaaauccacuuucacgaaacuccacgcacgaaauguacuggauauccaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaauggaacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcgguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7457 - RNA, 9873 nt, Artificial Sequence
  derived and/or modified CDS sequence (wt) from DENV-3__KJ189278__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaacuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaaugucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaucauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucauuacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacgcuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugacgauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguauugacauauaaugggaaaagacuggaaccaaacugggcuagcgugaaaaaagaucugauuucauacggaggaggauggagauugagcacacaauggcaaaagggagaggaggugcagguuauugccguagagccuggaaagaacccaaagaacuuucaaaccaugccaggcacuuuucagaccacaacaggggaaauaggggcaauugcacuagauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucauuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgccucagucaacauggugucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguagacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaaaauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7458 - RNA, 9873 nt, Artificial Sequence
  derived and/or modified CDS sequence (wt) from DENV-3__KJ189279__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagucaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaauacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaccauaggcuaaugucggcagccaucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaggagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacgcugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccuggaaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacauucacaaugcgucugcugucaccaguuaggguuccaaacuacaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaagguuauucaacuuaguaggaagacuuuugacacagaauaucagaaaacuaaacugaaugauugggacuuuguggugacaacugacauuucagaaaugggggccaauuucaaagcugacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaauauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagcuacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauuguguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaggacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7459 - RNA, 9873 nt, Artificial Sequence
  derived and/or modified CDS sequence (wt) from DENV-3__KJ189280__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagaugcccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcacugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaucauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucauuacagaaaacugugggacaagaggcccaucauugagaacaacaacagugucagggaaguuaauacacgaaugguguugccgcucuugcacacuuccuccccugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuaguuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccuggaaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccuggaucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacauucacaaugcgucugcugucaccaguuaggguuccaaacuacaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaacugacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuuuguggugacaacugacauuucagaaaugggggccaauuucaaagcugacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguaucaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacuuauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaaggcauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaauauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagcuacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguucacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7460 - RNA, 9873 nt, Artificial Sequence
  derived and/or modified CDS sequence (wt) from DENV-3__KJ189281__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucaaaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacaguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguagaagauuauggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacacacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuugguuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugaccguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuacuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagccgaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuuuguggugacaacugacauuucagaaaugggggccaauuucaaagcugacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauaggaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaaugcuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccagucccuauguccacauauggauggaauauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaauauggaugucauuggggaaagaauaaaaaggaucaaggaggagcauaauucaacauggcacuaugaugacgagaaccccuacaaaacgugggcuuaccauggaucuuaugaagucaaagcuacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggagugcugucaaaggcagaccuggagaacccucaucugccagagaagaaaauuacacaaugguuggaaacuaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuuuugcucccaccacuuccaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7461 - RNA, 9873 nt, Artificial Sequence
  derived and/or modified CDS sequence (wt) from DENV-3__KJ189282__SS-prME
acaucgcucugucucaugaugauauugccagcagcacuugcuuuccacuugacuucacgagauggagagccgcgcaugauuguggggaagaaugaaagaggaaaaucccuacuuuuuaaaacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucugcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcauggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguagugcaauaugagaaucucaaauacaccgucaucaucacagugcauacaggagaucaacaccaggugggaaaugaaacgcagggagucacggcugagauaacaccucaggcaucaaccacugaagccaccuugccagaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauugggaucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagaggcguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguucagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaaccaaacugaaugauugggacuucguggugacaacugacauuucagaaaugggggccaauuucaaagcugacagagugaucgacccaagaagaugucucaagccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaauauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaauuuuuuaugaugguguugcucauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuaucuagcaggagcugggcuugcuuuuucuaucaugaaaucaguaggaacagggaagagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggcgaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccauggcaggaacaagaagggucauggggaucacagcggaguggcucuggagaacccugggaaggaacaaaaaacccagguuaugcacaagggaagaguuuacaaagaaggucagaacuaacgcagccaugggcgccgucuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauaccuggaggagccauguaugcugaugacacagcugguugggacacaagaauaacagaagaugaccugcacaaugaggaaaagauuacacagcaaauggacccugaacacaggcaguuagcgaacgcuauauuuaagcuuacauaccaaaauaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauauuuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7462 - RNA, 9873 nt, Artificial Sequence
  derived and/or modified CDS sequence (wt) from DENV-3__KJ189283__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccuacguuggauauagagcuucagaagaccgaggccacccaauuggcgacccuaaggaagcuaugcauugaggggaaaauuaccaacauaacaacugacucaagauguccuacccaaggggaagcgguucugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacaggaaggagcuucuugugacauucaaaaacgcacaugcgaagaaacaagaaguaguuguccuuggaucgcaggagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuuuauaauagacgggccaaacacaccggaguguccaagugccucaagagcauggaaugugugggagguggaagauuauggguucggaguuuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccaaacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaaaacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuucagcuugaaagacacacucaaaaggaggagcuggccacugaacgaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagacauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguuuuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagacagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaagguuggccaauaucaaaaauggacuuaggaguacccuuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauucggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacucacagcaauucaacaggugagaagccuuauaggcaaugaagaguuucuggauuacaugccuucaaugaagagauuuaggaaggaggaggagucggagggagccauuugguaa

SEQ ID NO: 7463 - RNA, 9873 nt, Artificial Sequence
  derived and/or modified CDS sequence (wt) from DENV-3__KJ189284__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaaguuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagucaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaaucaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaucauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucauuacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacgcuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugacgauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguauugacauauaaugggaaaagacuggaaccaaacugggcuagcgugaaaaaagaucugauuucauacggaggaggauggagauugagcacacaauggcaaaagggagaggaggugcagguuauugccguagagccuggaaagaacccaaagaacuuucaaaccaugccaggcacuuuucagaccacaacaggggaaauaggggcaauugcacuagauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuuuguggugacaacugacauuucagaaaugggggccaauuucaaagcugacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagugcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaauauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagcuacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauuguguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaggacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7464 - RNA, 9873 nt, Artificial Sequence
  derived and/or modified CDS sequence (wt) from DENV-3__KJ189286__SS-prME
acaucguucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucaaaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacaguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaucauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucauuacagaaaacugugggacaagaggcccaucauugagaacaacaacagugucagggaaguuaauacacgaaugguguugccgcucuugcacacuuccuccccugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuaauuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccuggaaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcguuugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuuuguggugacaacugacauuucagaaaugggggccaauuucaaagcugacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauaggaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaaugcuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccagucccuauguccacauauggauggaauauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaauauggaugucauuggggaaagaauaaaaaggaucaaggaggagcauaauucaacauggcacuaugaugacgagaaccccuacaaaacgugggcuuaccauggaucuuaugaagucaaagcuacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggagugcugucaaaggcagaccuggagaacccucaucugccagagaagaaaauuacacaaugguuggaaacuaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuuuugcucccaccacuuccaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagggaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7465 - RNA, 9873 nt, Artificial Sequence
  derived and/or modified CDS sequence (wt) from DENV-3__KJ189287__SS-prME
acaucgcucugucucaugaugauauuaccagcagcacuugcuuuccacuugacuucacgagauggagagccgcgcaugauuguggggaagaaugaaagaggaaaaucccuacuuuuuaaaacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcauggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacucaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguagugcaauaugagaaucucaaauacaccgucaucaucacagugcauacaggagaucaacaccaggugggaaaugaaacgcagggagucacggcugagauaacaccucaggcaucaaccacugaagccaccuugccagaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauugggaucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguagaagauuacggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacacacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagaaacauggcgcacacacuaauaaugauuggguccaacgcaucugacaggaugggaaugggcguuaccuaccuagcuuuaauugcaacauuuaaaauucagccauucuugguuuugggauuuuuucuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugaccguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuacuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaagccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaauauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaauuuuuuaugaugguguugcucauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuaucuagcaggagcugggcuugcuuuuucuaucaugaaaucaguaggaacagggaagagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggcgaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccauggcaggaacaagaagggucauggggaucacagcggaguggcucuggagaacccugggaaggaacaaaaaacccagguuaugcacaagggaagaguuuacaaagaaggucagaacuaacgcagccaugggcgccgucuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauaccuggaggagccauguaugcugaugacacagcugguugggacacaagaauaacagaagaugaccugcacaaugaggaaaagauuacacagcaaauggacccugaacacaggcaguuagcgaacgcuauauuuaagcuuacauaccaaaauaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuaguggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauauuuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7466 - RNA, 9873 nt, Artificial Sequence
  derived and/or modified CDS sequence (wt) from DENV-3__KJ189288__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaacuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaauggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagcccgucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaaugucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagaggcguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcgggcguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaagcugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguucagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucauuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuguaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgccucagucaacauggugucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguagacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaaaauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7467 - RNA, 9873 nt, Artificial Sequence
  derived and/or modified CDS sequence (wt) from DENV-3__KJ189289__SS-prME
acaucgcucugucucaugaugauauugccagcagcacuugcuuuccacuugacuucacgagauggagagccgcgcaugauuguggggaagaaugaaagaggaaaaucccuacuuuucaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauauuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugaaauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguaguacaagcugacaugggguguguuauaaacuggaaaggcaaagaacucaaauguggaaguggaaucuucgucaccaacgagguccauaccuggacagagcaauacaaauuccaagcggacuccccaaaaagauuggcgacagccauugcaggugcuugggagaauggagugugcggaauuaggucaacaaccagaauggaaaaucuccuguggaagcaaauagccaaugaacugaacuacauauugugggaaaacaauaucaaauuaacgguaguugugggcgauacaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaucaauuguggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccacaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaagacuuugcggcuggcagaaagucaaucgcccuugaucuugugacagaaauaggaagagugccuucacaccuagcccauagaacgagaaacgcucuggacaaucugguaaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuucaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccugugauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauuucuaauggcacagguaacauugucgccucagucaauaugguaucuagacugcuacugaacagguucacgaugacacacagaagacccaccauugagaaagauguggauuugggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacgcagauggcaaugacagacacaacuccauuuggccagcaaagagucuuuaaagagaaaguagacaccaggacacccagguccaugccaggaacaagaagggucauggggaucacagcggaguggcucuggagaacccugggaaggaacaaaaaacccagguuaugcacaagggaagaguucacaaagaaggucagaaccaacgcagccaugggcgccguuuucacagaggagaaccaaugggacagcgcgaaaacugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcagcagagcuauaugguacaugugguugggagccagguaccuugaguuugaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcccaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7468 - RNA, 9873 nt, Artificial Sequence
  derived and/or modified CDS sequence (wt) from DENV-3__KJ189290__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagccuuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccuacguuggauauagagcuucagaagaccgaggccacccaauuggcgacccuaaggaagcuaugcauugaggggaaaauuaccaacauaacaacugacucaagauguccuacccaaggggaagcgguucugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaucucaaauacacugucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacaggaaggagcuucuugugacauucaaaaacgcacaugcgaagaaacaagaaguaguuguccuuggaucgcaggagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuuaacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuauggguucggaguuuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaucacacccaaacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagaaacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacucuuuauuuucagcuugaaagacacacucaaaaggaggagcuggccacugaacgaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagacauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguuuuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuuugcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuugcugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggauuugcacccagcaucagccuggacauuguacgccguggccacuacaguaauaacaccaauguuaagacauaccauagagaauuccacagcaaaugugucucuggcagcuauagccaaccaggcagugguccugauggguuuggacaaagguuggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccgauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaccaauuaucccggaaagaguuugaccuuuacaagagaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacaugucaaugcagaaccagaaacacccaacauggaugucauuggggaaagaauaaaaaggaucaaggaggagcauaauucaacauggcacuaugaugaagagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagcuauuugguaa

SEQ ID NO: 7469 - RNA, 9873 nt, Artificial Sequence
  derived and/or modified CDS sequence (wt) from DENV-3__KJ189291__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagccuuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccuacguuggauauagagcuucagaagaccgaggccacccaauuggcgacccuaaggaagcuaugcauugaggggaaaauuaccaacauaacaacugacucaagauguccuacccaaggggaagcgguucugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaucucaaauacacugucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacaggaaggagcuucuugugacauucaaaaacgcacaugcgaagaaacaagaaguaguuguccuuggaucgcaggagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuuaacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuauggguucggaguuuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaucacacccaaacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagaaacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacucuuuauuuucagcuugaaagacacacucaaaaggaggagcuggccacugaacgaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagacauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguuuuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuuugcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuugcugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggauuugcacccagcaucagccuggacauuguacgccguggccacuacaguaauaacaccaauguuaagacacaccauagagaauuccacagcaaaugugucucuggcagcuauagccaaccaggcagugguccugauggguuuggacaaagguuggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccgauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaccaauuaucccggaaagaguuugaccuuuacaagagaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacaugucaaugcagaaccagaaacacccaacauggaugucauuggggaaagaauaaaaaggaucaaggaggagcauaauucaacauggcacuaugaugaagagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggacucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagcuauuugguaa

SEQ ID NO: 7470 - RNA, 9873 nt, Artificial Sequence
  derived and/or modified CDS sequence (wt) from DENV-3__KJ189292__SS-prME
acgucgcucugucucaugaugauauugccagcagcacuugcuuuccacuugacuucacgagauggagagccgcgcaugauaguggggaagaaugaaagaggaaaaucccuacuuuuuaagacagccucuggaaucaacaugugcacacucauagccauggacuugggagagaugugugaugacacggucacuuacaaauguccccacauuaccgaagcggaacccgaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaagaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaaaauuccuuucuccacagaggauggacacgggaaagcucacaauggcagacugauuacagccaacccaguggugacuaagaaggaggagccugucaauauugaggcugaaccuccuuuuggggaaaguaauauaaugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguggugcaagcugacaugggguguauuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacucaacuaugugaccauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaacggugugcuagagagugacaugaucaucccaaagagucuagcugguccuaucucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccauuagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacuuuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagacauaacgugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaucccaggcacuuuucagacuacaacaggggaaauaggggcaauugcacuggacuucaagccuggaacuucaggaucuccuaucauaaacagagagggaaagguagugggacuguaugguaauggagugguuacaaagaauggugguuacgucagcggaauagcacaaacgaaugcagaaccagauggaucgacaccagaauuggaagaagagauguucaaaaagcgaaaucuaaccauaauggaucuucauccugggucaggaaagacacggaaauaccuuccagcuauuguuagagaggcaaucaagagacgucuaagaacacuuauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccguggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuggcccauaaaguagcaucagaagggaucaaauauacagacagaaaaugguguuuugauggacaacguaacaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaaggaauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuauugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugcgaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggacagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugcgcaggacugaaaaaagucacagaagugcgaggauacacaaaaggcgguccaggacaugaagaaccaguaccuauguccacauauggauggaacauaguuaaguuaaugaguggaaaagauguguuuuaucuuccaccugaaaagugugacaccuugcugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacaggcaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacuacacaaacuaggcuauauauuaagggacauuuccaaaauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaaguccaguuaaucagacaaauggaaggagaaggugugcugucaaaggcagaccuggagaacccccaucugccagagaagaaaauuacacaaugguuggaaaccaaaggaguggagagguuaaaaagaauggccauuaguggggaugauugcguggugaaaccaaucgaugacagguucgcuaaugcccugcucgcucugaacgauaugggaaagauucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauuggcaaugaagaguuucuggacuacaugccuucaaugaagagauuuaggaaggaggaggagucggagggagccauuugguaa

SEQ ID NO: 7471 - RNA, 9873 nt, Artificial Sequence
  derived and/or modified CDS sequence (wt) from DENV-3__KJ189293__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaagggaagcucuauugggaagauguucgaggccacugccagaggugcaaggcgcauggcuaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccuggaaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuuuguggugacaacugacauuucagaaaugggggccaauuucaaagcugacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaauauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagcuacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7472 - RNA, 9873 nt, Artificial Sequence
  derived and/or modified CDS sequence (wt) from DENV-3__KJ189294__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguagugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauugggaucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguagaagauuacggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugaccguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggcgaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaagguuagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaauaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7473 - RNA, 9873 nt, Artificial Sequence
  derived and/or modified CDS sequence (wt) from DENV-3__KJ189295__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagccuuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaaaaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuuuacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaauugggcuagcgugaaaaaagaucugauuucauacggaggaggauggagauugagcacacaauggcaaaagggagaggaggugcagguuauugccguagagccuggaaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuuuguggugacaacugacauuucagaaaugggggccaauuucaaagcugacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuuacugaucacacauuaugccauuauagguccaggauugcaggcaaaagcuacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaauauaguuaaguuaaugaguggaaaggauguguuuuaucuaccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagcuacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcuguuaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacagaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7474 - RNA, 9873 nt, Artificial Sequence
  derived and/or modified CDS sequence (wt) from DENV-3__KJ189297__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacguucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaauggguguccuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauagcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuucccagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7475 - RNA, 9873 nt, Artificial Sequence
  derived and/or modified CDS sequence (wt) from DENV-3__KJ189298__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagccuuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccuacguuggauauagagcuucagaagaccgaggccacccaauuggcgacccuaaggaagcuaugcauugaggggaaaauuaccaacauaacaacugacucaagauguccuacccaaggggaagcgguucugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccuuuaccauggacaucaggagcuacaacggaaacaccaaccuggaacaggaaggagcuucuugugacauucaaaaacgcacaugcgaagaaacaagaaguaguuguccuuggaucgcaggagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuauggguucggaguuuucacaaccaacauaugguugagacuccgagagguguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccaaacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacgguugcugguaugguauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagaaacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuucagcuugaaagacacacucaaaaggaggagcuggccacugaacgaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagacauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguuuuaugggacguacccagccccccagagacacagaaagcagaacuggaagaaggggucuauaggaucaaacagcaaggaauuuuuggaaaaacccaaguagggguuggaguacagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacaacaggggaaauaggggcaauugcacuggauuucaagccuggaacuucaggaucuccuaucauaaacagagagggaaagguagugggacuguaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuuugcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccuaaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuugcugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauuccacagcaaaugugucucuggcagcuauagccaaccaggcagugguccugauggguuuggacaaagguuggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugaagagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7476 - RNA, 9873 nt, Artificial Sequence
  derived and/or modified CDS sequence (wt) from DENV-3__KJ189301__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaacuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcuugagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaucucaaauacaccgucaucaucacagugcauacaggagaucaacaccaggugggaaaugaaacgcagggagucacggcugagauaacaccucaggcaucaaccacugaagccaccuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacuaguauuuuugcggggcacuuaaaaugcagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacacgggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggagguguucugaacucauuaggcaaaauggugcaccaaauauucggaagugcuuacacagcccuauucaguggagucucuuggguaaugaaaauuggaauaggaguucucuugacuuggauagggcugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauauaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaaugucaaauuaacgguaguugugggcgauauaauuggggucuuagagcggggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauaugguugagacuccgagaggcguacacccaacuaugugaccauaggcuaaugucggcagccgucaaggaugagagggccguacaugccgacaugggcuauuggauagaaagucaaaagaauggaaguuggaagcuagaaaaagcaucccucauagaggugaagaccugcacauggccaaaaucacauacccuuuggaguaacggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugucgcucgugcacacuuccucccuugcgauacaugggagaagacgguugcugguaugguauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugauaggaugggaaugggcguuaccuaccuagcuuuaauugcaacauuuaaaauucagccauucuuggcuuugggauuuuuccuaagaaagcugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacgauuuucacguugacuguugccuggagaacagccaccuugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacugguacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguucagaaagaaggggucuuccacaccauguggcacguuacaagaggggcaguguugacauauaaugggaaaagacuggaaccaaacugggcuagcgugaaaaaagaucugauuucauacggaggaggauggagauugagcacacaauggcaaaagggagaggaggugcagguuauugccguagagccugggaagaacccaaagaacuuucaaaccaugccaggcacuuuucagacuacgacaggggaaauaggggcaauugcacuggauuucaagccuggaacuucaggaucuccuaucauaaacagagagggaaagguagugggacuuuaugguaauggagugguuacaaagaauggugguuacgucagcggaauagcacaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacaacugacauuucagaaaugggggccaauuucaaagcugacagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucauuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaaugguguuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggauugcgucggcuauaguccuggaguuuuuuaugaugguguugcuuguaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauuccacagcaaaugugucucuggcagcuauagccaaccaggcagugguccugauggguuuggacaaaggauggccaauaucaaaaauggacuuaggaguaccccuacuggcauugggcugcuauucacaagugaacccacuaacucuaacagcggcaguacucuuacugaucacacauuaugccauuauagguccaggauugcaggcaaaagccacucgugaagcucagaaaaggacagccgcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucucccaccugaaaagugugacacccuguugugugacauuggagaaucuucaccaagcccaacaguggaagaaagcagaacuauaagaguuuugaagaugguugaaccaugguuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgccucagucaacauggugucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgagaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcaaagagucuuuaaagagaaaguagacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaagcuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaaacuaggcuauauauuaagggacauuuccaaaauacccggaggagccauguaugcugaugacacagcugguugggacacaagaauaacagaagaugaccugcacaaugaggaaaagaucacacagcaaauggacccugaacacaggcaguuagcgaacgcuauauuuaagcuuacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuggagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7477 - RNA, 9873 nt, Artificial Sequence
  derived and/or modified CDS sequence (wt) from DENV-3__KF955456__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuguacuacuaaugcuggucaccccauccaugacaaugagaugugugggaguaggaaacagggauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagcuaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggcuguacaugccgacaugggcuauuggauagaaagccaaaagaauggaagcuggaagcuagaaaaagcaucccucauagaggugaaaaccugcacauggccaaaaucacauacccuuuggaguaaugguguguuagagagcgauaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaguaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacaucgaacaaauggcaaauggaaucgcucuggggcucauggcucuuaaacugauaacacaauuugaaacauaccaauuauggacagcauuaaucuccuuaacguguucaaacacaaucuuuacgcugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcaacauuguuggucuggcacacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaaccucaggaucuccuaucauaaacagagagggaaaaguaguaggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagccauuguuagagaggcaaucaagagacguuuaagaacucuaauucuggcaccgacgagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguauauaucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggagaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuugugugauugcuuccagcggcauguuguggauggccgaaaucccacuccaauggaucgcgucggccauaguccuggaguuuuuuaugaugguguugcuuauaccagaaccagagaagcagagaaccccccaagacaaccaacuugcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaauucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaauauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagauuauguacaagggaagaguuuacaaaaaaggucagaacuaaugcagccaugggagccguuuucacagaggagaaccaaugggacagcgcgaaggcugcuguugaggaugaggacuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuuuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugacaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccauuuucaugaauugaucaugaaagauggaagaaaguugguaguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuauaugccuucaaugaagagauuuaggaaggaggaggagucggagggagccauuugguaa

SEQ ID NO: 7478 - RNA, 9873 nt, Artificial Sequence
  derived and/or modified CDS sequence (wt) from DENV-3__KF955465__SS-prME
acaucgcucuguaucaugaugauacugccagcagcacuugcuuuccacuugaccucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaauggucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacuuuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7479 - RNA, 9873 nt, Artificial Sequence
  derived and/or modified CDS sequence (wt) from DENV-3__KF955466__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacgggugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggagcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaacuagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugagaaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacuuuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacaaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaugcuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugauuaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7480 - RNA, 9873 nt, Artificial Sequence
  derived and/or modified CDS sequence (wt) from DENV-3__KF955468__SS-prME
acaucgcucugucucaugaugauacugccagcagcacuugcuuuccacuugaccucacgagauggagagccgcgcaugauuguggggaagaaugaaagaggaaaaucccuacuuuuuaagacagccucuggaauuaauaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuuggugacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcagggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauucuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaggguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacuuuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucgccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagcuaugggagccguuuucacagaggagaaccaaugggacagcgcgaaagcugcuguugaggaugaggauuuuuggacacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauuuaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguga

SEQ ID NO: 7481 - RNA, 9873 nt, Artificial Sequence
  derived and/or modified CDS sequence (wt) from DENV-3__FJ744726__SS-prME
acaucgcucugucucaugaugauguuaccagcaacacuugcuuuccacuugacuucacgugauggagaaccgcgcaugauuguggcgaagaaugaaagagggaaaucccuacuuuucaagacagcuucuggaaucaacaugugcacacucauagccauggacuugggagagaugugugaugacacggucacuuacaaaugcccccucauugccgaaguggaaccugaagacauugacugcuggugcaaccuuacaucgacaugggugaccuauggaacgugcaaucaagcuggggagcauagacgcgacaagagaucaguugcguuagcuccccaugucggcaugggacuggacacacgcacccaaaccuggaugucggccgaaggagcuuggagacaagucgagaagguagagacaugggcccuuaggcacccagguuucaccauacuagcucuauuucuugcccauuacauaggcacuucccugacccagaaagugguuauuuuuauacuacuaaugcuggucacuccauccaugacaaugagaugugugggagugggaaacagagauuuuguggaaggucugucgggagcuacguggguugauguggugcucgagcacggugggugcgugacuaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaacaugagaaccucaaauacacugucaucaucacagugcacacaggagaccaacaccaggugggaaaugacacgcagggagucacgguugagauaacaccccaggcaucaaccgucgaagcuaucuugccugaguauggaacccuugggcuagaaugcucaccacggacagguuuggauuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaaguaguuguccuuggaucgcaagagggagcaaugcacacagcgcugacaggggcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccagugguuacuaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcuaaacuacauauuaugggaaaacaacaucaaacuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacagacccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaaguugauacacgaaugguguugccgcucgugcacacuuccucccuugagauacaugggagaggacggcugcugguauggcauggaaauuagaccuaucaaugagaaagaagagaacaugguaaagucuuuagucucagcagggaguggaaagauggacaacuucacaaugggaauccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauuuaaaauccagccauucuuggccuugggauucuuucugaggaaacugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuuuagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugaaaacauccuaacagugcucuuaaaaacagcauuacuaauagucucaggcaucuuuccauacuccauacccgccacacuguuggucuggcauacuuggcaaaagcaaacccaaagaucuggcguucuaugggauguaccuagccccccagaaacacagaaagcagaacuggaagagggggucuauaggaucaaacaacaaggaauuuuugggaaaacccaaguagggguuggagugcagaaagaaggagucuuccacaccauguggcacgucacaagaggggcaguauugacgcacaaugggaaaagacuggaaccaaacugggcuagcgugaaaaaagaucugauuucauacggaggaggauggagauugagugcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuccauccugggucaggaaagacgcggaaauaucuuccagccaucgucagagaagcaaucaagagacgcuuaagaacucuaauuuuggcgccaacaagagugguugcagcugagauggaagaagcacugaaaggacucccaauaagguaucaaacaacugcaauaaaaucugaacacacaggaagggagauuguugaucuaaugugccacgcaacguucacaaugcgcuugcugucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugccgaagccuuuccucagagcaacgcuccaauucaagaugaagaaaaggacauuccggaacgcucauggaauucaggcaaugaauggaucaccgacuuuguugggaagacggugugguuugucccuagcaucaaagccggaaaugacauagcaaauugucugcgaaaaaauggaaaaaaggucauccaacuuaguaggaagacuuuugauacagaauaucaaaagaccagacugaaugauugggacuucguggugacaacagauauuucagaaaugggagcuaacuuuaaagcagauagagugauugacccaagaagaugucucaagccaguaauuuuaacagauggacccgagcgggugauccuggcuggaccaaugccagucaccgcagcgagcgcugcacaaaggagagggagaguuggcaggaacccacaaaaagaaaaugaccaguacauauucacgggccagccucucaacaaugacgaagaccaugcucacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagcaucagaaggaaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuacucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauagucuuggaauuuuucaugaugguguugcucauaccagaaccagaaaaacagagaacuccccaagacaaccaacucgcauaugucgugauaggcauacuuacacuggcugcgauaguaacagccaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcauugggcugcuauucacaagugaacccauugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggcccugugugaagcucuaacccuggccacaggaccaauaacaacacucugggaaggaucaccuggaaaauuuuggaacaccacgauagcuguuuccauggcuaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauaguuaagcuaaugaguggaaaggacguguuuuaucuuccacccgaaaagugugacacccuauugugugacauuggagaaucuucaccaagcccaacaguggaagaaagcagaacuauaagaguuuuaaagaugguugagccauggcuaaaaaacaaccaguuuugcauuaaaguauuaaacccuuacaugccaacugugauugagcaccuagaaagacuacaaagaaaacauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacaugggcuuaccauggauccuaugaagucaaagccacaggcucagccuccuccaugauaaauggagucgugaaacuccucacaaaaccaugggauguggugcccauggugacacagauggcaaugacagauacaacuccauuugggcagcaaagaguuuucaaagagaaaguggacaccaggacacccaggccuaugccagggacaagaaagguuauggagaucacagcggaauggcuuuggagaacucugggaaggaacaaaagacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagagcgugaacuccacaaauuaggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagcuauguaugcugaugacacagcugguugggacacaagaauaacagaagaugaccugcacaaugaggaaaaaaucacacagcaaauggauccugaacauagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcucaguuagucagacagauggaaggagaaggcguguugucgaagguagaccucgagaacccucaucugcuagagaagaaaaucacacaaugguuggaaaccaaaggaguggagagauuaagaagaauggccaucagcggggaugauugcguggugaaaccgaucgaugacagguuugccaaugcccugcucgcccugaacgacaugggaaagguuaggaaggacauaccucaauggcagccaucaaagggauggcaugauuggcaacaggucccuuucugcucccaccacuuucaugaacugaucaugaaagauggaagaaaguuggugguucccugcagaccccaggacgaacuaauaggaagagcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucaucggucucacuuccagagcaaccugggcccagaacauacucacagcaauccaacaggugagaagccuuauaggcgaugaagaauuucuagacuacaugccuucgaugaagagauucaggaaggaggaggagucagagggagccauuugguaa

SEQ ID NO: 7482 - RNA, 9873 nt, Artificial Sequence
  derived and/or modified CDS sequence (wt) from DENV-3__FJ744729__SS-prME
acaucgcucugucucaugaugauguuaccagcaacacuugcuuuccacuugacuucacgugauggagaaccgcgcaugauuguggcgaagaaugaaagagggaaaucccuacuuuucaagacagcuucuggaaucaacaugugcacacucauagccauggacuugggagagaugugugaugacacggucacuuacaaaugcccccucauugccgaaguggaaccugaagacauugacugcuggugcaaccuuacaucgacaugggugaccuauggaacgugcaaucaagcuggggagcauagacgcgacaagagaucaguugcguuagcuccccaugucggcaugggacuggacacacgcacccaaaccuggaugucggccgaaggagcuuggagacaagucgagaagguagagacaugggcccuuaggcacccagguuucaccauacuagcucuauuucuugcccauuacauaggcacuucccugacccagaaagugguuauuuuuauacuacuaaugcuggucacuccauccaugacaaugagaugugugggagugggaaacagagauuuuguggaaggucugucgggagcuacguggguugauguggugcucgagcacggugggugcgugacuaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuaaaaccaauagagggaaaaguggugcaacaugagaaccucaaauacacugucaucaucacagugcacacaggagaccaacaccaggugggaaaugacacgcagggagucacgguugagauaacaccccaggcaucaaccgucgaagcuaucuugccugaguauggaacccuugggcuagaaugcucaccacggacagguuuggauuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaaguaguuguccuuggaucgcaagagggagcaaugcacacagcgcugacaggggcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccagugguuacuaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcuaaacuacauauuaugggaaaacaacaucaaacuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacagacccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaaguugauacacgaaugguguugccgcucgugcacacuuccucccuugagauacaugggagaggacggcugcugguauggcauggaaauuagaccuaucaaugagaaagaagagaacaugguaaagucuuuagucucagcagggaguggaaagauggacaacuucacaaugggaauccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauuuaaaauccagccauucuuggccuugggauucuuucugaggaaacugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuuuagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugaaaacauccuaacagugcucuuaaaaacagcauuacuaauagucucaggcaucuuuccauacuccauacccgccacacuguuggucuggcauacuuggcaaaagcaaacccaaagaucuggcguucuaugggauguaccuagccccccagaaacacagaaagcagaacuggaagagggggucuauaggaucaaacaacaaggaauuuuugggaaaacccaaguagggguuggagugcagaaagaaggagucuuccacaccauguggcacgucacaagaggggcaguauugacgcacaaugggaaaagacuggaaccaaacugggcuagcgugaaaaaagaucugauuucauacggaggaggauggagauugagugcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuccauccugggucaggaaagacgcggaaauaucuuccagccaucgucagagaagcaaucaagagacgcuuaagaacucuaauuuuggcgccaacaagagugguugcagcugagauggaagaagcacugaaaggacucccaauaagguaucaaacaacugcaauaaaaucugaacacacaggaagggagauuguugaucuaaugugccacgcaacguucacaaugcgcuugcugucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugccgaagccuuuccucagagcaacgcuccaauucaagaugaagaaagggacauuccggaacgcucauggaauucaggcaaugaauggaucaccgacuuuguugggaagacggugugguuugucccuagcaucaaagccggaaaugacauagcaaauugucugcgaaaaaauggaaaaaaggucauccaacuuaguaggaagacuuuugauacagaauaucaaaagaccagacugaaugauugggacuucguggugacaacagauauuucagaaaugggagcuaacuuuaaagcagauagagugauugacccaagaagaugucucaagccaguaauuuuaacagauggacccgagcgggugauccuggcuggaccaaugccagucaccgcagcgagcgcugcacaaaggagagggagaguuggcaggaacccacaaaaagaaaaugaccaguacauauucacgggccagccucucaacaaugacgaagaccaugcucacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagcaucagaaggaaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuacucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauagucuuggaauuuuucaugaugguguugcucauaccagaaccagaaaaacagagaacuccccaagacaaccaacuugcauaugucgugauaggcauacuuacacuggcugcgauaguaacagccaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcauugggcugcuauucacaagugaacccauugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggcccugugugaagcucuaacccuggccacaggaccaauaacaacacucugggaaggaucaccuggaaaguuuuggaacaccacgauagcuguuuccauggcuaacaucuuuagagggagcuacuuagcaggagcugggcuugcuuuuucuaucaugagaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauaguuaagcuaaugaguggaaaggacguguuuuaucuuccacccgaaaagugugacacccuauugugugacauuggagaaucuucaccaagcccaacaguggaagaaagcagaacuauaagaguuuuaaagaugguugagccauggcuaaaaaacaaccaguuuugcauuaaaguauuaaacccuuacaugccaacugugauugagcaccuagaaagacuacaaagaaaacauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacaugggcuuaccauggauccuaugaagucaaagccacaggcucagccuccuccaugauaaauggagucgugaaacuccucacaaaaccaugggauguggugcccauggugacacagauggcaaugacagauacaacuccauuugggcagcaaagaguuuucaaagagaaaguggacaccaggacacccaggccuaugccagggacaagaaagguuauggagaucacagcggaauggcuuuggagaacucugggaaggaacaaaagacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagagcgugaacuccacaaauuaggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagcuauguaugcugaugacacagcugguugggacacaagaauaacagaagaugaccugcacaaugaggaaaaaaucacacagcaaauggauccugaacauagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcucaguuagucagacagauggaaggagaaggcguguugucgaagguagaccucgagaacccucaucugcuagagaagaaaaucacacaaugguuggaaaccaaaggaguggagagauuaagaagaauggccaucagcggggaugauugcguggugaaaccgaucgaugacagguuugccaaugcccugcucgcccugaacgacaugggaaagguuaggaaggacauaccucaauggcagccaucaaagggauggcaugauuggcaacaggucccuuucugcucccaucacuuucaugaacugaucaugaaagauggaagaaaguuggugguucccugcagaccccaggacgaacuaauaggaagagcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucaucggucucacuuccagagcaaccugggcccagaacauacucacagcaauccaacaggugagaagccuuauaggcgaugaagaauuucuagacuacaugccuucgaugaagagauucaggaaggaggaggagucagagggagccauuugguaa

SEQ ID NO: 7483 - RNA, 9873 nt, Artificial Sequence
  derived and/or modified CDS sequence (wt) from DENV-3__FJ687448__SS-prME
acaucgcucugucucaugaugauguuaccagcaacacuugcuuuccacuugacuucacgugauggagaaccgcgcaugauuguggcgaagaaugaaagagggaaaucccuacuuuucaagacagcuucuggaaucaacaugugcacacucauagccauggacuugggagagaugugugaugacacggucacuuacaaaugcccccucauugccgaaguggaaccugaagacauugacugcuggugcaaccuuacaucgacaugggugaccuauggaacgugcaaucaagcuggggagcauagacgcgacaagagaucaguugcguuagcuccccaugucggcaugggacuggacacacgcacccaaaccuggaugucggccgaaggagcuuggagacaagucgagaagguagagacaugggcccuuaggcacccagguuucaccauacuagcucuauuucuugcccauuacauaggcacuucccugacccagaaagugguuauuuuuauacuacuaaugcuggucacuccauccaugacaaugagaugugugggagugggaaacagagauuuuguggaaggucugucgggagcuacguggguugauguggugcucgagcacggugggugcgugacuaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaacaugagaaccucaaauacacugucaucaucacagugcacacaggagaccaacaccaggugggaaaugacacgcagggagucacgguugagauaacaccccaggcaucaaccgucgaagcuaucuugccugaguauggaacccuugggcuagaaugcucaccacggacagguuuggacuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaaguaguuguccuuggaucgcaagagggagcaaugcacacagcgcugacaggggcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccagugguuacuaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcuaaacuacauauuaugggaaaacaacaucaaacuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacagacccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaaguugauacacgaaugguguugccgcucgugcacacuuccucccuugagauacaugggagaggacggcugcugguauggcauggaaauuagaccuaucaaugagaaagaagagaacaugguaaagucuuuagucucagcagggaguggaaagauggacaacuucacaaugggaauccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauuuaaaauccagccauucuuggccuugggauucuuucugaggaaacugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuuuagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugaaaacauccuaacagugcucuuaaaaacagcauuacuaauagucucaggcaucuuuccauacuccauacccgccacacuguuggucuggcauacuuggcaaaagcaaacccaaagaucuggcguucuaugggauguaccuagccccccagaaacacagaaagcagaacuggaagagggggucuauaggaucaaacaacaaggaauuuuugggaaaacccaaguagggguuggagugcagaaagaaggagucuuccacaccauguggcacgucacaagaggggcaguauugacgcacaaugggaaaagacuggaaccaaacugggcuagcgugaaaaaagaucugauuucauacggaggaggauggagauugagugcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuccauccugggucaggaaagacgcggaaauaucuuccagccaucgucagagaagcaaucaagagacgcuuaagaacucuaauuuuggcgccaacaagagugguugcagcugagauggaagaagcacugaaaggacucccaauaagguaucaaacaacugcaauaaaaucugaacacacaggaagggagauuguugaucuaaugugccacgcaacguucacaaugcgcuugcugucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugccgaagccuuuccucagagcaacgcuccaauucaagaugaagaaagggacauuccggaacgcucauggaauucaggcaaugaauggaucaccgacuuuguugggaagacggugugguuugucccuagcaucaaagccggaaaugacauagcaaauugucugcgaaaaaauggaaaaaaggucauccaacuuaguaggaagacuuuugauacagaauaucaaaagaccagacugaaugauugggacuucguggugacaacagauauuucagaaaugggagcuaacuuuaaagcagauagagugauugacccaagaagaugucucaagccaguaauuuuaacagauggacccgagcgggugauccuggcuggaccaaugccagucaccgcagcgagcgcugcacaaaggagagggagaguuggcaggaacccacaaaaagaaaaugaccaguacauauucacgggccagccucucaacaaugacgaagaccaugcucacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagcaucagaaggaaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuacucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauagucuuggaauuuuucaugaugguguugcucauaccagaaccagaaaaacagagaacuccccaagacaaccaacucgcauaugucgugauaggcauacuuacacuggcugcgauaguaacagccaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcauugggcugcuauucacaagugaacccauugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggcccugugugaagcucuaacccuggccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauaguuaagcuaaugaguggaaaggacguguuuuaucuuccacccgaaaagugugacacccuauugugugacauuggagaaucuucaccaagcccaacaguggaagaaagcagaacuauaagaguuuuaaagaugguugagccauggcuaaaaaacaaccaguuuugcauuaaaguauuaaacccuuacaugccaacugugauugagcaccuagaaagacuacaaagaaaacauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacaugggcuuaccauggauccuaugaagucaaagccacaggcucagccuccuccaugauaaauggagucgugaaacuccucacaaaaccaugggauguggugcccauggugacacagauggcaaugacagauacaacuccauuugggcagcaaagaguuuucaaagagaaaguggacaccaggacacccaggccuaugccagggacaagaaagguuauggagaucacagcggaauggcuuuggagaacucugggaaggaacaaaagacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagagcgugaacuccacaaauuaggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagcuauguaugcugaugacacagcugguugggacacaagaauaacagaagaugaccugcacaaugaggaaaaaaucacacagcaaauggauccugaacauagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcucaguuagucagacagauggaaggagaaggcguguugucgaagguagaccucgagaacccucaucugcuagagaagaaaaucacacaaugguuggaaaccaaaggaguggagagauuaagaagaauggccaucagcggggaugauugcguggugaaaccgaucgaugacagguuugccaaugcccugcucgcccugaacgacaugggaaagguuaggaaggacauaccucaauggcagccaucaaagggauggcaugauuggcaacaggucccuuucugcucccaccacuuucaugaacugaucaugaaagauggaagaaaguuggugguucccugcagaccccaggacgaacuaauaggaagagcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucaucggucucacuuccagagcaaccugggcccagaacauacucacagcaauccaacaggugagaagccuuauaggcgaugaagaauuucuagacuacaugcccucgaugaagagauucaggaaggaggaggagucagagggagccauuugguaa

SEQ ID NO: 7484 - RNA, 9873 nt, Artificial Sequence
  derived and/or modified CDS sequence (wt) from DENV-3__FJ744732__SS-prME
acaucgcucugucucaugaugauguuaccagcaacacuugcuuuccacuugacuucacgugauggagaaccgcgcaugauuguggcgaagaaugaaagagggaaaucccuacuuuucaagacagcuucuggaaucaacaugugcacacucauagccauggacuugggagagaugugugaugacacggucacuuacaaaugcccccucauugccgaaguggaaccugaagacauugacugcuggugcaaccuuacaucgacaugggugaccuauggaacgugcaaucaagcuggggagcauagacgcgacaagagaucaguugcguuagcuccccaugucggcaugggacuggacacacgcacccaaaccuggaugucggccgaaggagcuuggagacaagucgagaagguagagacaugggcccuuaggcacccagguuucaccauacuagcucuauuucuugcccauuacauaggcacuucccugacccagaaagugguuauuuuuauacuacuaaugcuggucacuccauccaugacaaugagaugugugggagugggaaacagagauuuuguggaaggucugucgggagcuacguggguugauguggugcucgagcacggugggugcgugacuaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaacaugagaaccucaaauacacugucaucaucacagugcacacaggagaccaacaccaggugggaaaugacacgcagggagucacgguugagauaacaccccaggcaucaaccgucgaagcuaucuugccugaguauggaacccuugggcuagaaugcucaccacggacagguuuggacuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaaguaguuguccuuggaucgcaagagggagcaaugcacacagcgcugacaggggcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccagugguuacuaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcuaaacuacauauuaugggaaaacaacaucaaacuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacagacccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaaguugauacacgaaugguguugccgcucgugcacacuuccucccuugagauacaugggagaggacggcugcugguauggcauggaaauuagaccuaucaaugagaaagaagagaacaugguaaagucuuuagucucagcagggaguggaaagauggacaacuucacaaugggaauccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauuuaaaauccagccauucuuggccuugggauucuuucugaggaaacugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuuuagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugaaaacauccuaacagugcucuuaaaaacagcauuacuaauagucucaggcaucuuuccauacuccauacccgccacacuguuggucuggcauacuuggcaaaagcaaacccaaagaucuggcguucuaugggauguaccuagccccccagaaacacagaaagcagaacuggaagagggggucuauaggaucaaacaacaaggaauuuuugggaaaacccaaguagggguuggagugcagaaagaaggagucuuccacaccauguggcacgucacaagaggggcaguauugacgcacaaugggaaaagacuggaaccaaacugggcuagcgugaaaaaagaucugauuucauacggaggaggauggagauugagugcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuccauccugggucaggaaagacgcggaaauaucuuccagccaucgucagagaagcaaucaagagacgcuuaagaacucuaauuuuggcgccaacaagagugguugcagcugagauggaagaagcacugaaaggacucccaauaagguaucaaacaacugcaauaaaaucugaacacacaggaagggagauuguugaucuaaugugccacgcaacguucacaaugcgcuugcugucaccagucaggguuccaaauuacaauuugauaauaauggaugaggcccauuuuacagauccagccaguauagcggcuagaggguacauaucaacucguguaggaaugggagaggcagcugcaauuuucaugacagcaacacccccuggaacugccgaagccuuuccucagagcaacgcuccaauucaagaugaagaaagggacauuccggaacgcucauggaauucaggcaaugaauggaucaccgacuuugcugggaagacggugugguuugucccuagcaucaaagccggaaaugacauagcaaauugucugcgaaaaaauggaaaaaaggucauccaacuuaguaggaagacuuuugauacagaauaucaaaagaccagacugaaugauugggacuucguggugacaacagauauuucagaaaugggagcuaacuuuaaagcagauagagugauugacccaagaagaugucucaagccaguaauuuuaacagauggacccgagcgggugauccuggcuggaccaaugccagucaccgcagcgagcgcugcacaaaggagagggagaguuggcaggaacccacaaaaagaaaaugaccaguacauauucacgggccagccucucaacaaugacgaagaccaugcucacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagcaucagaaggaaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuacucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauagucuuggaauuuuucaugaugguguugcucauaccagaaccagaaaaacagagaacuccccaagacaaccaacucgcauaugucgugauaggcauacuuacacuggcugcgauaguaacagccaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcauugggcugcuauucacaagugaacccauugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggcccugugugaagcucuaacccuggccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauaguuaagcuaaugaguggaaaggacguguuuuaucuuccacccgaaaagugugacacccuauugugugacauuggagaaucuucaccaagcccaacaguggaagaaagcagaacuauaagaguuuuaaagaugguugagccauggcuaaaaaacaaccaguuuugcauuaaaguauuaaacccuuacaugccaacugugauugagcaccuagaaagacuacaaagaaaacauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacaugggcuuaccauggauccuaugaagucaaagccacaggcucagccuccuccaugauaaauggagucgugaaacuccucacaaaaccaugggauguggugcccauggugacacagauggcaaugacagauacaacuccauuugggcagcaaagaguuuucaaagagaaaguggacaccaggacacccaggccuaugccagggacaagaaagguuauggagaucacagcggaauggcuuuggagaacucugggaaggaacaaaagacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagagcgugaacuccacaaauuaggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagcuauguaugcugaugacacagcugguugggacacaagaauaacagaagaugaccugcacaaugaggaaaaaaucacacagcaaauggauccugaacauagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcucaguuagucagacagauggaaggagaaggcguguugucgaagguagaccucgagaacccucaucugcuagagaagaaaaucacacaaugguuggaaaccaaaggaguggagagauuaagaagaauggccaucagcggggaugauugcguggugaaaccgaucgaugacagguuugccaaugcccugcucgcccugaacgacaugggaaagguuaggaaggacauaccucaauggcagccaucaaagggauggcaugauuggcaacaggucccuuucugcucccaccacuuucaugaacugaucaugaaagauggaagaaaguuggugguucccugcagaccccaggacgaacuaauaggaagagcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucaucggucucacuuccagagcaaccugggcccagaacauacucacagcaauccaacaggugagaagccuuauaggcgaugaagaauuucuagacuacaugcccucgaugaagagauucaggaaggaggaggagucagagggagccauuugguaa

SEQ ID NO: 7485 - RNA, 9873 nt, Artificial Sequence
  derived and/or modified CDS sequence (wt) from DENV-3__FJ810414__SS-prME
acaucgcucugucucaugaugauguuaccagcaacacuugcuuuccacuugacuucacgugacggagaaccgcgcaugauuguggcgaagaaugaaagagggaaaucccuacuuuucaagacagcuucuggaaucaacaugugcacacucauagccauggacuugggagagaugugugaugacacggucacuuacaaaugcccccucauugccgaaguggaaccugaagacauugacugcuggugcaaccuuacaucgacaugggugaccuauggaacgugcaaucaagcuggggagcauagacgcgacaagagaucaguugcguuagcuccccaugucggcaugggacuggacacacgcacccaaaccuggaugucggccgaaggagcuuggagacaagucgagaagguagagacaugggcccuuaggcacccagguuucaccauacuagcucuauuucuugcccacuacauaggcacuucccugacccagaaagugguuauuuuuauacuacuaaugcuggucacuccauccaugacaaugagaugugugggagugggaaacagagauuuuguggaaggucugucgggagcuacguggguugauguggugcucgagcacggugggugcgugacuaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaacaugagaaccucaaauacacugucaucaucacagugcacacaggagaccaacaccaggugggaaaugacacgcagggagucacgguugagauaacaccccaggcaucaaccgucgaagcuaucuugccugaguauggaacccuugggcuagaaugcucaccacggacagguuuggacuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaaguaguuguccuuggaucgcaagagggagcaaugcacacagcgcugacaggggcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccagugguuacuaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugaaguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcuaaacuacauauuaugggaaaacaacaucaaacuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacagacccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaaguugauacacgaaugguguugccgcucgugcacacuuccucccuugagauacaugggagaggacggcugcugguauggcauggaaauuagaccuaucaaugagaaagaagagaacauggcaaagucuuuagucucagcagggaguggaaagauggacaacuucacaaugggaauccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauuuaaaauccagccauucuuggccuugggauucuuucugaggaaacugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuuuagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugaaaacauccuaacagugcucuuaaaaacagcauuacuaauagucucaggcaucuuuccauacuccauacccgccacacuguuggucuggcauacuuggcaaaagcaaacccaaagaucuggcguucuaugggauguaccuagccccccagaaacacagaaagcagaacuggaagagggggucuauaggaucaaacaacaaggaauuuuugggaaaacccaaguagggguuggagugcagaaagaaggagucuuccacaccauguggcacgucacaagaggggcaguauugacgcacaaugggaaaagacuggaaccaaacugggcuagcgugaaaaaagaucugauuucauacggaggaggauggagauugagugcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuccauccugggucaggaaagacgcggaaauaucuuccagccaucgucagagaagcaaucaagagacgcuuaagaacucuaauuuuggcgccaacaagagugguugcagcugagauggaagaagcacugaaaggacucccaauaagguaucaaacaacugcaauaaaaucugaacacacaggaagggagauuguugaucuaaugugccacgcaacguucacaaugcgcuugcugucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugccgaagccuuuccucagagcaacgcuccaauucaagaugaagaaagggacauuccggaacgcucauggaauucaggcaaugaauggaucaccgacuuuguugggaagacggugugguuugucccuagcaucaaagccggaaaugacauagcaaauugucugcgaaaaaauggaaaaaaggucauccaacuuaguaggaagacuuuugauacagaauaucaaaagaccagacugaaugauugggacuucguggugacaacagauauuucagaaaugggagcuaacuuuaaagcagauagagugauugacccaagaagaugucucaagccaguaauuuuaacagauggacccgagcgggugauccuggcuggaccaaugccagucaccgcagcgagcgcugcacaaaggagagggagaguuggcaggaacccacaaaaagaaaaugaccaguacauauucacgggccagccucucaacaaugacgaagaccaugcucacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagcaucagaaggaaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuacucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauagucuuggaauuuuucaugaugguguugcucauaccagaaccagaaaaacagagaacuccccaagacaaccaacucgcauaugucgugauaggcauacucacacuggcugcgauaguaacagccaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcauugggcugcuauucacaagugaacccauugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggcccugugugaagcucuaacccuggccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauaguuaagcuaaugaguggaaaggacguguuuuaucuuccacccgaaaagugugacacccuauugugugacauuggagaaucuucaccaagcccaacaguggaagaaagcagaacuauaagaguuuuaaagaugguugagccauggcuaaaaaacaaccaguuuugcauuaaaguauuaaacccuuacaugccaacugugauugagcaccuagaaagacuacaaagaaaacauggaggaaugcucgugagaaacccacucucacgaaacuccacgcaugaaauguacuggauauccaaugguaccggcaacaucgucucuucagucaauaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacaugggcuuaccauggauccuaugaagucaaagccacaggcucagccuccuccaugauaaauggagucgugaaacuccucacaaaaccaugggauguggugcccauggugacacagauggcaaugacagauacaacuccauuugggcagcaaagaguuuucaaagagaaaguggacaccaggacacccaggccuaugccagggacaagaaagguuauggagaucacagcggaauggcuuuggagaacucugggaaggaacaaaagacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagagcgugaacuccacaaauuaggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagcuauguaugcugaugacacagcugguugggacacaagaauaacagaagaugaccugcacaaugaggaaaaaaucacacagcaaauggauccugaacauagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcucaguuagucagacagauggaaggagaaggcguguugucgaagguagaccucgagaacccucaucugcuagagaagaaaaucacacaaugguuggaaaccaaaggaguggagagauuaagaagaauggccaucagcggggaugauugcguggugaaaccgaucgaugacagguuugccaaugcccugcucgcccugaacgacaugggaaagguuaggaaggacauaccucaauggcagccaucaaagggauggcaugauuggcaacaggucccuuucugcucccaccacuuucaugaacugaucaugaaagauggaagaaaguuggugguucccugcagaccccaggacgaacuaauaggaagagcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucaucggucucacuuccagagcaaccugggcccagaacauacucacagcaauccaacaggugagaagccuuauaggcgaugaagaauuucuagacuacaugcccucgaugaagagauucaggaaggaggaggagucagagggagccauuugguaa

SEQ ID NO: 7486 - RNA, 9873 nt, Artificial Sequence
  derived and/or modified CDS sequence (wt) from DENV-3__FJ744734__SS-prME
acaucgcucugucucaugaugauguuaccagcaacacuugcuuuccacuugacuucacgugauggagaaccgcgcaugauuguggcgaagaaugaaagagggaaaucccuacuuuucaagacagcuucuggaaucaacaugugcacacucauagccauggacuugggagagaugugugaugacacggucacuuacaaaugcccccucauugccgaaguggaaccugaagacauugacugcuggugcaaccuuacaucgacaugggugaccuauggaacgugcaaucaagcuggggagcauagacgcgacaagagaucaguugcguuagcuccccaugucggcaugggacuggacacacgcacccaaaccuggaugucggccgaaggagcuuggagacaagucgagaagguagagacaugggcccuuaggcacccagguuucaccauacuagcucuauuucuugcccauuacauaggcacuucccugacccagaaagugguuauuuuuauacuacuaaugcuggucacuccauccaugacaaugagaugugugggagugggaaacagagauuuuguggaaggucugucgggagcuacguggguugauguggugcucgagcacggugggugcgugacuaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaacaugagaaccucaaauacacugucaucaucacagugcacacaggagaccaacaccaggugggaaaugacacgcagggagucacgguugagauaacaccccaggcaucaaccgucgaagcuaucuugccugaguauggaacccuugggcuagaaugcucaccacggacagguuuggacuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaaguaguuguccuuggaucgcaagagggagcaaugcacacagcgcugacaggggcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccagugguuacuaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcuaaacuacauauuaugggaaaacaacaucaaacuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacagacccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaaguugauacacgaaugguguugccgcucgugcacacuuccucccuugagauacaugggagaggacggcugcugguauggcauggaaauuagaccuaucaaugagaaagaagagaacaugguaaagucuuuagucucagcagggaguggaaagauggacaacuucacaaugggaauccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauuuaaaauccagccauucuuggccuugggauucuuucugaggaaacugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuuuagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugaaaacauccuaacagugcucuuaaaaacagcauuacuaauagucucaggcaucuuuccauacuccauacccgccacacuguuggucuggcauacuuggcaaaagcaaacccaaagaucuggcguucuaugggauguaccuagccccccagaaacacagaaagcagaacuggaagagggggucuauaggaucaaacaacaaggaauuuuugggaaaacccaaguagggguuggagugcagaaagaaggagucuuccacaccauguggcacgucacaagaggggcaguauugacgcacaaugggaaaagacuggaaccaaacugggcuagcgugaaaaaagaucugauuucauacggaggaggauggagauugagugcacaauggcaaaagggagaggaggugcagguuauugccguagagccugggaagaacccaaaaaacuuucaaaccaugccgggcauuuuucagacaacaaugggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuccauccugggucaggaaagacgcggaaauaucuuccagccaucgucagagaagcaaucaagagacgcuuaagaacucuaauuuuggcgccaacaagagugguugcagcugagauggaagaagcacugaaaggacucccaauaagguaucaaacaacugcaauaaaaucugaacacacaggaagggagauuguugaucuaaugugccacgcaacguucacaaugcgcuugcugucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugccgaagccuuuccucagagcaacgcuccaauucaagaugaagaaagggacauuccggaacgcucauggaauucaggcaaugaauggaucaccgacuuuguugggaagacggugugguuugucccuagcaucaaagccggaaaugacauagcaaauugucugcgaaaaaauggaaaaaaggucauccaacuuaguaggaagacuuuugauacagaauaucaaaagaccagacugaaugauugggacuucguggugacaacagauauuucagaaaugggagcuaacuuuaaagcagauagagugauugacccaagaagaugucucaagccaguaauuuuaacagauggacccgagcgggugauccuggcuggaccaaugccagucaccgcagcgagcgcugcacaaaggagagggagaguuggcaggaacccacaaaaagaaaaugaccaguacauauucacgggccagccucucaacaaugacgaagaccaugcucacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagcaucagaaggaaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuacucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauagucuuggaauuuuucaugaugguguugcucauaccagaaccagaaaaacagagaacuccccaagacaaccaacucgcauaugucgugauaggcauacuuacacuggcugcgauaguaacagccaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcauugggcugcuauucacaagugaacccauugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggcccugugugaagcucuaacccuggccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauaguuaagcuaaugaguggaaaggacguguuuuaucuuccacccgaaaagugugacacccuauugugugacauuggagaaucuucaccaagcccaacaguggaagaaagcagaacuauaagaguuuuaaagaugguugagccauggcuaaaaaacaaccaguuuugcauuaaaguauuaaacccuuacaugccaacugugauugagcaccuagaaagacuacaaagaaaacauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacaugggcuuaccauggauccuaugaagucaaagccacaggcucagccuccuccaugauaaauggagucgugaaacuccucacaaaaccaugggauguggugcccauggugacacagauggcaaugacagauacaacuccauuugggcagcaaagaguuuucaaagagaaaguggacaccaggacacccaggccuaugccagggacaagaaagguuauggagaucacagcggaauggcuuuggagaacucugggaaggaacaaaagacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagagcgugaacuccacaaauuaggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagcuauguaugcugaugacacagcugguugggacacaagaauaacagaagaugaccugcacaaugaggaaaaaaucacacagcaaauggauccugaacauagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcucaguuagucagacagauggaaggagaaggcguguugucgaagguagaccucgagaacccucaucugcuagagaagaaaaucacacaaugguuggaaaccaaaggaguggagagauuaagaagaauggccaucagcggggaugauugcguggugaaaccgaucgaugacagguuugccaaugcccugcucgcccugaacgacaugggaaagguuaggaaggacauaccucaauggcagccaucaaagggauggcaugauuggcaacaggucccuuucugcucccaccacuuucaugaacugaucaugaaagauggaagaaaguuggugguucccugcagaccccaggacgaacuaauaggaagagcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucaucggucucacuuccagagcaaccugggcccagaacauacucacagcaauccaacaggugagaagccuuauaggcgaugaagaauuucuagacuacaugcccucaaugaagagauucaggaaggaggaggagucagagggagccauuugguaa

SEQ ID NO: 7487 - RNA, 9873 nt, Artificial Sequence
  derived and/or modified CDS sequence (wt) from DENV-3__FJ744737__SS-prME
acaucgcucugucucaugaugauguuaccagcaacacuugcuuuccacuugacuucacgugauggagaaccgcgcaugauuguggcgaagaaugaaagagggaaaucccuacuuuucaagacagcuucuggaaucaacaugugcacacucauagccauggacuugggagagaugugugaugacacggucacuuacaaaugcccccucauugccgaaguggaaccugaagacauugacugcuggugcaaccuuacaucgacaugggugaccuauggaacgugcaaucaagcuggggagcauagacgcgacaagagaucaguugcguuagcuccccaugucggcaugggacuggacacacgcacccaaaccuggaugucggccgaaggagcuuggagacaagucgagaagguagagacaugggcccuuaggcacccagguuucaccauacuagcucuauuucuugcccauuacauaggcacuucccugacccagaaagugguuauuuuuauacuacuaaugcuggucacuccauccaugacaaugagaugugugggagugggaaacagagauuuuguggaaggucugucgggagcuacguggguugauguggugcucgagcacggugggugcgugacuaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaacaugagaaccucaaauacacugucaucaucacagugcacacaggagaccaacaccaggugggaaaugacacgcagggagucacggcugagauaacaccccaggcaucaaccgucgaagcuaucuugccugaguauggaacccuugggcuagaaugcucaccacggacagguuuggacuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaaguaguuguccuuggaucgcaagagggagcaaugcacacagcgcugacaggggcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccagugguuacuaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcuaaacuacauauuaugggaaaacaacaucaaacuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacagacccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaaguugauacacgaaugguguugccgcucgugcacacuuccucccuugagauacaugggagaggacggcugcugguauggcauggaaauuagaccuaucaaugagaaagaagagaacaugguaaagucuuuagucucagcagggaguggaaagauggacaacuucacaaugggaauccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauuuaaaauccagccauucuuggccuugggauucuuucugaggaaacugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuuuagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugaaaacauccuaacagugcucuuaaaaacagcauuacuaauagucucaggcaucuuuccauacuccauacccgccacacuguuggucuggcauacuuggcaaaagcaaacccaaagaucuggcguucuaugggauguaccuagccccccagaaacacagaaagcagaacuggaagagggggucuauaggaucaaacaacaaggaauuuuugggaaaacccaaguagggguuggagugcagaaagaaggagucuuccacaccauguggcacgucacaagaggggcaguauugacgcacaaugggaaaagacuggaaccaaacugggcuagcgugaaaaaagaucugauuucauacggaggaggauggagauugagugcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuccauccugggucaggaaagacgcggaaauaucuuccagccaucgucagagaagcaaucaagagacgcuuaagaacucuaauuuuggcgccaacaagagugguugcagcugagauggaagaagcacugaaaggacucccaauaagguaucaaacaacugcaauaaaaucugaacacacaggaagggagauuguugaucuaaugugccacgcaacguucacaaugcgcuugcugucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugccgaagccuuuccucagagcaacgcuccaauucaagaugaagaaagggacauuccggaacgcucauggaauucaggcaaugaauggaucaccgacuuuguugggaagacggugugguuugucccuagcaucaaagccggaaaugacauagcaaauugucugcgaaaaaauggaaaaaaggucauccaacuuaguaggaagacuuuugauacagaauaucaaaagaccagacugaaugauugggacuucguggugacaacagauauuucagaaaugggagcuaacuuuaaagcagauagagugauugacccaagaagaugucucaagccaguaauuuuaacagauggacccgagcgggugauccuggcuggaccaaugccagucaccgcagcgagcgcugcacaaaggagagggagaguuggcaggaacccacaaaaagaaaaugaccaguacauauucacgggccagccucucaacaaugacgaagaccaugcucacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagcaucagaaggaaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuacucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauagucuuggaauuuuucaugaugguguugcucauaccagaaccagaaaaacagagaacuccccaagacaaccaacucgcauaugucgugauaggcauacuuacacuggcugcgauaguaacagccaaugaaaugggauuauuggaaacuacaaagagagauuuaggaaugucuaaagaaccagguguuguuucuccaaccagcuauuuagauguagauuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcauugggcugcuauucacaagugaacccauugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggcccugugugaagcucuaacccuggccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauaguuaagcuaaugaguggaaaggacguguuuuaucuuccacccgaaaagugugacacccuauugugugacauuggagaaucuucaccaagcccaacaguggaagaaagcagaacuauaagaguuuuaaagaugguugagccauggcuaaaaaacaaccaguuuugcauuaaaguauuaaacccuuacaugccaacugugauugagcaccuagaaagacuacaaagaaaacauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacaugggcuuaccauggauccuaugaagucaaagccacaggcucagccuccuccaugauaaauggagucgugaaacuccucacaaaaccaugggauguggugcccauggugacacagauggcaaugacagauacaacuccauuugggcagcaaagaguuuucaaagagaaaguggacaccaggacacccaggccuaugccagggacaagaaagguuauggagaucacagcggaauggcuuuggagaacucugggaaggaacaaaagacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagagcgugaacuccacaaauuaggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagcuauguaugcugaugacacagcugguugggacacaagaauaacagaagaugaccugcacaaugaggaaaaaaucacacagcaaauggauccugaacauagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcucaguuagucagacagauggaaggagaaggcguguugucgaagguagaccucgagaacccucaucugcuagagaagaaaaucacacaaugguuggaaaccaaaggaguggagagauuaagaagaauggccaucagcggggaugauugcguggugaaaccgaucgaugacagguuugccaaugcccugcucgcccugaacgacaugggaaagguuaggaaggacauaccucaauggcagccaucaaagggauggcaugauuggcaacaggucccuuucugcucccaccacuuucaugaacugaucaugaaagauggaagaaaguuggugguucccugcagaccccaggacgaacuaauaggaagagcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucaucggucucacuuccagagcaaccugggcccagaacauacucacagcaauccaacaggugagaagccuuauaggcgaugaagaauuucuagacuacaugcccucgaugaagagauucaggaaggaggaggagucagagggagccauuugguaa

SEQ ID NO: 7488 - RNA, 9873 nt, Artificial Sequence
  derived and/or modified CDS sequence (wt) from DENV-3__FJ744739__SS-prME
acaucgcucugucucaugaugauguuaccagcaacacuugcuuuccacuugacuucacgugauggagaaccgcgcaugauuguggcgaagaaugaaagagggaaaucccuacuuuucaagacaguuucuggaaucaacaugugcacacucauagccauggacuugggagagaugugugaugacacggucacuuacaaaugcccccucauugccgaaguggaaccugaagacauugacugcuggugcaaccuuacaucgacaugggugaccuauggaacgugcaaucaagcuggggagcauagacgcgacaagagaucaguugcguuagcuccccaugucggcaugggacuggacacacgcacccaaaccuggaugucggccgaaggagcuuggagacaagucgagaagguagagacaugggcccuuaggcacccagguuucaccauacuagcucuauuucuugcccauuacauaggcacuucccugacccagaaagugguuauuuuuauacuacuaaugcuggucacuccauccaugacaaugagaugugugggagugggaaacagagauuuuguggaaggucugucgggagcuacguggguugauguggugcucgagcacggugggugcgugacuaccauggcuaagaacaagccuacgcuggacauagagcuucagaagaccgaggccacccaacuggcgacccuaaggaaguuaugcauugaggggaaaauuaccaacauaacaacugacucaagguguccuacccagggggaagcgauuuuaccugaggagcaggaccagaacuacguauguaagcacacauacguggauagggguuggggaaacgguugugguuuguuuggaaaaggaagcuuggugacaugcgcgaaauuucaaugucuagaaccaauagagggaaaaguggugcaacaugagaaccucaaauacacugucaucaucacagugcacacaggagaccaacaccaggugggaaaugacacgcagggagucacgguugagauaacaccccaggcaucaaccgucgaagcuaucuugccugaguauggaacccuugggcuagaaugcucaccacggacagguuuggauuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccagugguuacuaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcuaaacuacauauuaugggaaaacaacaucaaacuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagccuagcugguccuauuucacaacacaaccacagacccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaaguugauacacgaaugguguugccgcucgugcacacuuccucccuugagauacaugggagaggacggcugcugguauggcauggaaauuagaccuaucaaugagaaagaagagaacaugguaaagucuuuagucucagcagggaguggaaagauggacaacuucacaaugggaauccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauuuaaaauccagccauucuuggccuugggauucuuucugaggaaacugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacaugcucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuuuagcuugaaggacacaccuaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauagucucaggcaucuuuccauacuccauacccgccacacuguuggucuggcauacuuggcaaaagcaaacccaaagaucuggcguucuaugggauguaccuagccccccagaaacacagaaagcagaacuggaagagggggucuauaggaucaaacaacaaggaauuuuugggaaaacccaaguagggguuggagugcagaaagaaggagucuuccacaccauguggcacgucacaagaggggcaguauugacgcacaaugggaaaagacuggaaccaaacugggcuagcgugaaaaaagaucugauuucauacggaggaggauggagauugagugcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuccauccugggucaggaaagacgcggaaauaucuuccagccaucgucagagaagcaaucaagagacgcuuaagaacucuaauuuuggcgccaacaagagugguugcagcugagauggaagaagcacugaaaggacucccaauaagguaucaaacaacugcaauaaaaucugaacacacaggaagggagauuguugaucuaaugugccacgcaacguucacaaugcgcuugcugucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugccgaagccuuuccucagagcaacgcuccaauucaagaugaagaaagggacauuccggaacgcucauggaauucaggcaaugaauggaucaccgacuuuguugggaagacggugugguuugucccuagcaucaaagccggaaaugacauagcaaauugucugcgaaaaaauggaaaaaaggucauccaacuuaguaggaagacuuuugauacagaauaucaaaagaccagacugaaugauugggacuucguggugacaacagauauuucagaaaugggagcuaacuuuaaagcagauagagugauugacccaagaagaugucucaagccaguaauuuuaacagauggacccgagcgggugauccuggcuggaccaaugccagucaccgcagcgagcgcugcacaaaggagagggagaguugguaggaacccacaaaaagaaaaugaccaguacauauucacgggccagccucucaacaaugacgaagaccaugcucacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagcaucagaaggaaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuacucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauagucuuggaauuuuucaugaugguguugcucauaccagaaccagaaaaacagagaacuccccaagacaaccaacucgcauaugucgugauaggcauacuuacacuggcugcgauaguaacagccaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcauugggcugcuauucacaagugaacccauugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggcccugugugaagcucuaacccuggccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauaguuaagcuaaugaguggaaaggacguguuuuaucuuccacccgaaaagugugacacccuauugugugacauuggagaaucuucaccaagcccaacaguggaagaaagcagaacuauaagaguuuuaaagaugguugagccauggcuaaaaaacaaccaguuuugcauuaaaguauuaaacccuuacaugccaacugugauugagcaccuagaaagacuacaaagaaaacauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguagauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacaugggcuuaccauggauccuaugaagucaaagccacaggcucagccuccuccaugauaaauggagucgugaaacuccucacaaaaccaugggauguggugcccauggugacacagauggcaaugacagauacaacuccauuugggcagcaaagaguuuucaaagagaaaguggacaccaggacacccaggcccaugccagggacaagaaagguuauggagaucacagcggaauggcuuuggagaacucugggaaggaacaaaagacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagagcgugaacuccacaaauuaggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagcuauguaugcugaugacacagcugguugggacacaagaauaacagaagaugaccugcacaaugaggaaaaaaucacacagcaaauggauccugaacauagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcucaguuagucagacagauggaaggagaaggcguguugucgaagguagaccucgagaacccucaucugcuagagaagaaaaucacacaaugguuggaaaccaaaggaguggagagauuaagaagaauggccaucagcggggaugauugcguggugaaaccgaucgaugacagguuugccaaugcccugcucgcccugaacgacaugggaaagguuaggaaggacauaccucaauggcagccaucaaagggauggcaugauuggcaacaggucccuuucugcucccaccacuuucaugaacugaucaugaaagauggaagaaaguuggugguucccugcagaccccaggacgaacuaauaggaagagcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucauucaucggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7489 - RNA, 9873 nt, Artificial Sequence
  derived and/or modified CDS sequence (wt) from DENV-3__FJ744740__SS-prME
acaucgcucugucucaugaugauguuaccagcaacacuugcuuuccacuugacuucacgugauggagaaccgcgcaugauuguggcgaagaaugaaagagggaaaucccuacuuuucaagacagcuucuggaaucaacaugugcacacucauagccauggacuugggagagaugugugaugacacggucacuuacaaaugcccccucauugccgaaguggaaccugaagacauugacugcuggugcaaccuuacaucgacaugggugaccuauggaacgugcaaucaagcuggggagcauagacgcgacaagagaucaguugcguuagcuccccaugucggcaugggacuggacacacgcacccaaaccuggaugucggccgaaggagcuuggagacaagucgagaagguagagacaugggcccuuaggcacccagguuucaccauacuagcucuauuucuugcccauuacauaggcacuucccugacccagaaagugguuauuuuuauacuacuaaugcuggucacuccauccaugacaaugagaugugugggagugggaaacagagauuuuguggaaggucugucgggagcuacguggguugauguggugcucgagcacggugggugcgugacuaccauagcuaagaacaagcccacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaagggagcuuggugacaugcgcgaaauuucaaugucuagaaccaauagagggaaaaguggugcaacaugagaaccucaaauacacugucaucaucacagugcacacaggagaccaacaccaggugggaaaugacacgcagggagucacgguugagauaacaccccaggcaucaaccgucgaagcuaucuugccugaguauggaacccuugggcuagaaugcucaccacggacagguuuggauuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaaguaguuguccuuggaucgcaagagggagcaaugcacacagcguugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccagugguuacuaagaaggaggagccugucaacauugaggcugaaccuccuuuuggggaaagcaacauagugauuggaguuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggaguuucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcuaaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacagacccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaaguugauacacgaaugguguugccgcucgugcacgcuuccucccuugagauacaugggagaggacggcugcugguauggcauggaaauuagaccuaucaaugagaaagaagagaacaugguaaagucuuuagucucagcagggaguggaaagguggacaacuucacaaugggaauccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauuuaaaauccagccauucuuggccuugggauucuuucugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuuuagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauagucucaggcaucuuuccauacuccauacccgccacacuguuggucuggcauacuuggcaaaagcaaacccaaagaucuggcguucuaugggauguaccuagccccccagaaacacagaaagcagaacuggaagagggggucuauaggaucaaacaacaaggaauuuuugggaaaacccaaguagggguuggagugcagaaagaaggagucuuccacaccauguggcacgucacaagaggggcaguauugacgcacaauggaaaaagacuggaaccaaacugggcuagcgugaaaaaagaucugauuucauacggaggaggauggagauugagugcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuccauccugggucaggaaagacgcggaaauaucuuccagccaucgucagagaagcaaucaagagacgcuuaagaacucuaauuuuggcgccaacaagagugguugcagcugagauggaagaagcacugaaaggacucccaauaagguaucaaacaacugcaauaaaaucugaacacacaggaagggagauuguugaucuaaugugccacgcaacguucacaaugcgcuugcugucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugccgaagccuuuccucagagcaacgcuccaauucaagaugaagaaagggacauuccggaacgcucauggaauucaggcaaugaauggaucaccgacuuuguugggaagacggugugguuugucccuagcaucaaagccggaaaugacauagcaaauugucugcgaaaaaauggaaaaaaggucauccaacuuaguaggaagacuuuugauacagaauaucaaaagaccagacugaaugauugggacuucguggugacaacagauauuucagaaaugggagcuaacuuuaaagcagauagagugauugacccaagaagaugucucaagccaguaauuuuaacagauggacccgagcgggugauccuggcuggaccaaugccagucaccgcagcgagcgcugcacaaaggagagggagaguuggcaggaacccucaaaaggaaaaugaccaguauauauucacgggccagccucucaacaaugacgaagaccaugcucacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagcaucagaaggaaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuacucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauagucuuggaauuuuucaugaugguguugcucauaccagaaccagaaaaacagagaacuccccaagacaaccaacucgcauaugucgugauaggcauacuuacacuggcugcgauaguaacagccaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcauugggcugcuauucacaagugaacccauugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggcccugugugaagcucuaacccuggccacaggaccaauaacaacacucugggaaggaucacccggaaaguuuuggaacaccacgauagcuguuuccauggcuaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggacagaacagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauacuacugcgcaggacugaaaaaaguuacagaagugcgaggauacacaaaaggcggcccaggacacgaagaaccaguaccuaugucuacauacggauggaacauaguuaagcuaaugaguggaaaggacguguuuuaucuuccacccgaaaagugugacacccuauugugugacauuggagaaucuucaccaagcccaacaguggaagaaagcagaacuauaagaguuuuaaagaugguugagccauggcuaaaaaacaaccaguuuugcauuaaaguauuaaacccuuacaugccaacugugauugagcaccuagaaagacuacaaagaaaacauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacaugggcuuaccauggauccuaugaagucaaagccacaggcucagccuccuccaugauaaauggagucgugaaacuccucacaaaaccaugggauguggugcccauggugacacagauggcaaugacagauacaacuccauuugggcagcaaagaguuuucaaagagaaaguggacaccaggacacccaggcccaugccagggacaagaaagguuauggagaucacagcggaauggcuuuggagaacucugggaaggaacaaaagacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagagcgugaacuccacaaauuaggcaaguguggaagcugcgucuacaacaugaugggcaagagagagaagaaacuuggagaguuuggcaaagccaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagcuauguaugcugaugacacagcugguugggacacaagaauaacagaagaugaccugcacaaugaggaaaaaaucacacagcaaauggauccugaacauagacaauuagcgaacgccauauuuaagcucacauaucaaaacaaaguggucaaaguucaacgaccaacuccaaaaggcacgguaauggacauuauaucuaggaaagaccaaagaggcaguggacagguggggacuuauggucugaacacauucaccaacauggaagcucaguuagucagacagauggaaggagaaggcguguugucgaagguagaccucgagaacccucaucugcuagagaagaaaaucacacaaugguuggaaaccaaaggaguggagagauuaagaagaauggccaucagcggggaugauugcguggugaaaccgaucgaugacagguuugccaaugcccugcucgcccugaacgacaugggaaagguuaggaaggacauaccucaauggcagccaucaaagggauggcaugauuggcaacaggucccuuucugcucccaccacuuucaugaacugaucaugaaagauggaagaaaguuggugguucccugcagaccccaggacgaacuaauaggaagagcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucaucggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7490 - RNA, 9873 nt, Artificial Sequence
  derived and/or modified CDS sequence (wt) from DENV-3__GQ868593__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagccauggacuugggagagaugugugaugacacggucacuuacaaaugcccccacauugccgaaguggaaccugaagacauugacugcuggugcaaccuuacaucgacaugggugacuuauggaacgugcaaucaagcuggggagcacagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcucuauuucuugcccauuacauaggcacuuccuugacccagaaagugguuauuuuuauacuacuaauacuggucacuccauccauggcaaugagaugcgugggaguaggaaacagagauuuuguggaaggucuaucgggagcuacguggguugacguggugcucgagcacggugggugugugaccaccauggcuaagaacaagcccacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcauacauacguggauagaggcuggggaaacgguugugguuuguuuggaaaaggaagcuuggugacaugcgcgaaauuucaaugcuuagaaucaauagagggaaaaguggugcaacaugagaaccucaaauacacugucaucauuacagugcacacaggagaccaacaccaggugggaaaugaaacgcagggagucacggcugagauaacaccccaggcaucaaccguugaagcuaucuugccugaauauggaacccuugggcuagaaugcucaccacggacagguuuggauuucaaugaaaugaucuuauugacaaugaagaacaaagcauggaugguacauagacaaugguucuuugaccuaccccuaccauggacaucaggagcuacaacagagacaccaacuuggaacaggaaagagcuucuugugacauucaaaaaugcacaugcaaaaaagcaagaaguaguuguccuuggaucgcaagagggagcaaugcacacagcgcugacaggagcuacagagauccaaaacucaggaggcacaagcauuuuugcggggcacuugaaauguagacuuaagauggacaaauuggaacucaaggggaugagcuaugcaaugugcuugaacaccuuuguguugaagaaagaagucuccgagacgcagcaugggacaauacucauuaagguugaguacaaaggggaagaugcaccuugcaagauuccuuucuccacggaggauggacaagggaaagcucacaaugguagacugaucacagccaacccaguggugaccaagaaggaggagccugucaacauugaggcugaaccuccuuuuggggaaaguaacauagugauuggaauuggagacaaagccuugaaaauuaacugguacaagaagggaagcucgauugggaagauguucgaggccacugccagaggugcaaggcgcauggccaucuugggagacacagccugggacuuuggaucagugggugguguucugaauucauuagggaaaauggugcaccaaauauuuggaagugcuuacacagcccuguuuaguggagucucauggauaaugaaaauuggaauagguguccucuuaaccuggauaggguugaauucaaaaaacacuuccaugucauuuucauguauugcgauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacucccccaaaagacuggcgacagccauugcaggcgccugggaaaauggagucuguggaaucaggucaacaaccagaauggagaaucuauuguggaagcaaauagccaaugaacugaacuacauauuaugggaaaacaacaucaaauuaacgguaguggugggcgacauaauuggggucuuagagcaagggaaaagaacacuaacaccacaacccauggagcuaaaauauucauggaaaacauggggaaaagcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaauugugcgaccauaggcuaaugucagcagccgucaaagaugagagggccgugcaugccgacaugggcuauuggauagaaagccaaaagaauggaaguuggaagcuagaaaaagcaucccucauagagguaaaaaccugcacuuggccaaaaucacacacucuuuggaguaaugguguacuagagagugacaugaucaucccaaagagucuagcugguccuauuucgcaacacaaccacaggcccggguaccacacccaaacggcaggacccuggcacuugggaaaauuggagcuggacuucaacuauugugaaggaacaacaguugucaucacagaaaacugugggacaagaggcccaucauugagaacaacaacagugucggggaaguugauacacgaaugguguugccgcucgugcacacuuccucccuugcgauacaugggagaagacggcugcugguauggcauggaaauuagacccaucaaugagaaagaagagaacaugguaaagucuuuagccucagcagggaguggaaagguggacaacuucacaauggguguccuguguuuggcaauccucuucgaagaggugaugagaggaaaauuugggaaaaaacacaugauugcagggguucuccucacguuugugcuccuucucucagggcaaauaacauggagagauauggcgcacacacucauaaugauuggguccaacgcuucugacaggaugggaaugggcguuaccuaccuagcuuuaauugcaacauuuaaaauccagccauucuuggcuuugggauucuuccugaggaaauugacaucuagagaaaauuuacuguugggaguuggguuggccauggcaacaacguuacaacugccagaggacauugaacaaauggcgaauggaauugcucuggggcucauggcucuuaaacugauaacacaauuugagacauaccaguuauggacggcauuagucucccuaacguguucaaauacaauuuucacguugacuguugccuggagaacagccaccuugauucuggccggaguuucgcuuuugccagugugccagucuucgagcaugaggaaaacagauuggcucccaauggcuguggcagcuaugggaguuccacccuuaccacuuuucaucuucagcuugaaagauacacucaaaaggagaagcuggccacugaaugagggggugauggcuguugggcuugugagcauucuagcuagcucucuccuuaggaaugaugugcccauggcuggaccauuaguggccgggggcuugcugauagcgugcuacgucauaacuggcacgucagcggaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacagcauuacuaauaguaucaggcaucuuuccauauuccauacccgccacacuguuggucuggcauacuuggcaaaagcaaacccaaagaucuggcguucuaugggacguacccagccccccagaaacacagaaagcagaacuggaagagggggucuauaggaucaaacagcaaggaauuuuugggaaaacccaaguggggguuggaguacagaaagaaggagucuuccauaccauguggcacgucacaagaggggcaguguugacgcacaaugggaaaagauuggaaccaaacugggccagcgugaaaaaagaucugauuucauacggaggaggauggagauugagugcacaauggcaaaagggagaggaggugcagguuauugccguagagcccgggaagaacccaaagaacuuucaaaccaugccgggcauuuuucagacaacaacaggggaaauaggagcaauugcacuagacuucaagccuggaacuucaggaucuccuaucauaaacagagagggaaagguagugggacuguauggcaauggagugguuacaaagaaugguggcuacgucaguggaauagcgcaaacaaaugcagaaccagacggaccgacaccggaguuggaagaggagauguucaaaaagcgaaaucuaaccauaauggaucuucauccugggucaggaaagacgcggaaauaucuuccagcuaucgucagagaagcaaucaagagacgcuuaagaacucuaauuuuggcaccaacaagggugguugcagcugagauggaagaagcauugaaagggcucccaauaagguaucaaacaacugcaacaaaaucugaacacacaggaagggagauuguugaucuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaugccuuuccucagagcaacgcuccaauucaagaugaagaaagggauaucccggaacgcucauggaauucaggcaaugaauggauuaccgacuuuguugggaagacggugugguuuguccccagcaucaaagccggaaaugacauagcaaacugcuugcggaaaaauggaaaaaaggucauucaacuuaguaggaagacuuuugauacagaauaucaaaagaccaaacugaaugauugggacuucguggugacaacagacauuucagaaaugggagccaacuuuaaagcagauagagugaucgacccaagaagaugucucaagccagugauuuugacagauggacccgagcgggugauccuggcuggaccaaugccagucacugcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuggacaacaucaacacaccagaagggauuauaccagcucucuuugaaccagaaagggagaagucagccgccauagacggugaauaccgccugaagggugaguccaggaagaccuucguggaacucaugaggaggggugaccucccaguuuggcuagcccauaaaguagcaucagaagggaucaaauauacagauagaaaauggugcuuugauggagaacguaauaaucaaauuuuagaggagaacauggauguggaaaucuggacaaaggaaggagaaaagaaaaaauugagaccuagguggcuugaugcccgcacuuauucagaucccuuggcacucaaggaauucaaggauuuugcagcuggcagaaagucaaucgcccuugaucuugugacagaaauaggaagagugccuucacauuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuguucuugauaucagguaaagggauuggaaagacuucaauaggacucaucuguguaauugcuuccaguggcauguuauggauggccgaugucccacuucaauggaucgcgucggcuauaguccuggaauuuuucaugaugguguugcuuauaccagaaccagaaaagcagagaacuccccaagacaaccaacucgcauaugucgugauaggcauacuuacacuggcugcaauaguagcagccaaugaaaugggacuguuggaaacuacaaagagagauuuaggaaugucuaaagaaccagguguuguuucuccaaccagcuauuuagauguagacuugcacccagcaucagccuggacauuguacgcuguggccacaacaguaauaacaccaauguugagacauaccauagagaauuccacagcaaaugugucccuggcagcuauagcuaaccaggcagugguccugaugggcuuagacaaaggauggccaauaucgaaaauggacuuaggcguaccacuacuggcacugggcugcuauucacaagugaacccacugacucucacagcggcaguacuuuugcuagcuacacauuaugcuauuauagguccaggauugcaggcaaaagccacucgugaagcucaaaaaaggacagcugcuggaauaaugaagaauccaacgguggaugggauaaugacaauagaccuagauccuguaauauacgauucaaaauucgaaaagcaacuaggacagguuaugcuccuaguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuauuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaauaacacgucaugccguguccagaggcagcgcaaaacuucaaugguucguggagaggaacauggucauucccgaaggaagagucauagacuuaggcuguggaagaggaggcuggucauauuacugcgcaggauugaaaaaaguuacagaagugcgaggauacacaaaaggcggcccaggacacgaagaaccaguaccuaugucuacauacggauggaacauagucaaguuaaugaguggaaaggauguguuuuaucucccaccugaaaagugugacacccuauugugugacauuggagaaucuucaccaagcccaacaguggaagaaagcagaacuauaagaguuuugaagaugguugaaccauggcuaaaaaauaaccaguuuugcauuaaaguauuaaacccuuacaugccaacugugauugagcaccuagaaagacuacaaaggaaacauggaggaaugcuugugagaaauccacucucacgaaacuccacgcacgaaauguacuggauauccaaugguaccggcaacaucgucucuucagucaacaugguauccagauugcuacugaacagauuuacaaugacacacaggagacccaccauagagaaagauguggauuugggagcaggaacccgacaugucaaugcggaaccagaaacacccaauauggacgucauuggagaaagaauaaaaaggaucaaggaggagcauaauucaacauggcacuaugaugaugaaaauccuuacaaaacgugggcuuaccauggauccuaugaagucaaagccacaggcucagccuccuccaugauaaauggagucgugaaacuccucacaaaaccaugggauguggugcccauggugauacagauggcaaugacagauacaacuccauuugggcagcaaagaguuuucaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggcgccguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagcuauaugguacaugugguugggagccagguaccuugaguucgaggcacucggauucuuaaaugaagaccacugguucucgcgugaaaacucuuacaguggaguagaaggagaaggacugcacaagcugggauacauuuuaagagauauuuccaagauacccggaggagcuauguaugcugaugacacagcugguugggacacaagaauaacagaagaugaccugcacaaugaggaaaaaaucacacagcaaauggacccugaacacagacaguuagcgaacgccauauucaagcucacauaccaaaacaaaguggucaaaguucaacgaccaacuccaaaaggcacgguaauggacaucauaucuaggaaagaccaaagaggcaguggacagguggggacuuauggucugaauacauucaccaacauggaagcccaguuagucagacagauggaaggagaaggcguguugucgaaggcagaccuugagaauccucaucugcuagagaagaaaaucacacaaugguuggaaaccaaaggaguggagagguuaaaaagaauggcuaucaguggggaugauugcguagugaaaccgaucgacgacagguuugccaaugcccugcuugcccugaacgauaugggaaagguuaggaaggacauaccucaauggcagccaucaaaggguuggcaugauuggcaacaggucccuuucugcucccaccacuuucaugaacugaucaugaaagauggaagaaaguuggugguucccugcagaccccaggacgaacuaauaggaagagcgagaaucucucaaggagcaggauggagccuuaaagaaacugcaugucuagggaaagccuacgcucaaauguggagucucauguauuuucacagaagagaucuuagacuagcauccaacgccauauguucagcaguaccaguccauugggucccuacaagcagaacgacauggucuauucaugcucaccaucaguggaugacuacagaagacaugcuuacugucuggaacaggguguggauagaggacaauccauggauggaagacaaaacuccagucacaacuugggaagauguuccauaccuagggaagagagaagaccaauggugcggaucacucaucggucucacuuccagagcaaccugggcccagaacauacucacagcaauccaacaagugagaagccuuauaggcaaugaagaguuucuggacuacaugccuucgaugaagagauucaagaaggaggaggagucagagggagccauuugguaa

SEQ ID NO: 7491 - RNA, 9873 nt, Artificial Sequence
  derived and/or modified CDS sequence (wt) from DENV-3__FJ898459__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggagaagaugcaccuugcaagauuccuuucucuacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuuaaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaaccuauggagcuaaaauacucauggaaaacguggggaaaggcaaaaauagugacagcugaaacacaaaauucuucuuucauaauagacgggccaaacacaccggaguguccaagugccucaagagcauggaaugugugggagguggaagauuacggguucggagucuucacaaccaacauauggcugaaacuccgagagguguacacccaacuaugcgaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacacacccuuuggaguaauggugugcuagagagugacaugaucaucccaaagagucuagcugguccuauuucgcaacacaaccacaggcccggguaccacacccagacggccggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguuguugguauggcauggaaaucagacccauuagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaguccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaauugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccacuaccacucuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucacccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagauggugaguaucgcuugaaaggugagucuaggaagaccuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaccuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucugguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaggucaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggacagaacagaagccaaagaaggauugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacuguuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuucuggaaacuuguggacagagaacgugaacuccacaaauugggcaaguguggaagcuguguuuacaacaugaugggcaagagagagaagaaacuuggagaguuuggcaaagcaaaagguaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccgcaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccucauagguaaugaagaguuucuggacuacaugccuucaaugaagagauuuaggaaggaggaggagucggagggagccauuugguaa

SEQ ID NO: 7492 - RNA, 9873 nt, Artificial Sequence
  derived and/or modified CDS sequence (wt) from DENV-3__EU482555__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacauuggauauagagcuucagaagaccgaggccacccaauuggcgacccuaaggaaguuaugcauugaggggaaaauuaccaacauaacaacugacucaagauguccuacccaaggggaagcgguuuugccugaggagcaggaccagaacuacguguguaagcacacauacguggacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccucgggcuagaaugcucaccacggacagguuuggauuucaaugaaaugaucuugcuaacgaugaagaacaaagcauggaugguacauagacaaugguuuuuugaccuaccucugccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacuuaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggagucauuacacucuaucugggagcuguggugcaagcugacaugggauguguuauaaacuggaaaggcaaagaacucaaauguggaaguggaaucuucgucaccaaugagguccauaccuggacagagcaauacaaauuccaagcagacucaccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaauacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccgugcaugccgacaugggcuacuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaacuacaggcccggguaccacacccagacggcgggacccuggcauuuaggaaaauuagaccuggacuucaacuauugcgaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaagaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcgcuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugucagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcacacuuggcaaaagcaaacccaaagauccggcguucuaugggacguacccagccccccagagacacagaaagcagaacuggaagagggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacgucuaaggacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccaguuaggguuccaaauuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguagugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccaaccucucaauaaugaugaagaccacgcucacuggacagaagcaaaaaugcugcuggacaacauuaauacaccagaagggaucauaccagcucucuuugagccagaaagggagaagucagccgccauagacggugaguaucgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaucuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaacuccccaagacaaccaacucgcauaugucgugauaggcauacucacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucaaaaaaggacagcugcuggaauaaugaagaauccaacgguggaugggauaaugacaauagaccuagaucccguaauauaugauucaaaauuugaaaaacaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauaaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaacaacacaucaugccguguccagagguaccgcgaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagauuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaagagcauaauucaacauggcacuaugaugacgaaaaccccuacaaaacgugggcuuaccauggaucuuaugaaguuaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccaggcuaugcacaagggaagaguuuacaaaaaaggucagaaccaacgcagccaugggcgccguuuucacagaggagaaccaaugggauagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaagaagaauggccauuagcggggaugauugcguagugaaaccaaucgaugacagguucgcuaaugcccugcuugcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguauggaucgaggacaauccauggauggaagacaaaacuccagucacaaccugggaaaauguuccauauuuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7493 - RNA, 9873 nt, Artificial Sequence
  derived and/or modified CDS sequence (wt) from DENV-3__EU529692__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacauuggauauagagcuucagaagaccgaggccacccaauuggcgacucuaaggaaguuaugcauugaggggaaaauuaccaacauaacaacugacucaagauguccuacccaaggggaagcgguuuugccugaggagcaggaccagaacuacguguguaagcacacauacguggacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccucgggcuagaaugcucaccacggacagguuuggauuucaaugaaaugaucuugcuaacgaugaagaacaaagcauggaugguacauagacaaugguuuuuugaccuaccucugccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacuuaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggagucauuacacucuaucugggagcuguggugcaagcugacaugggauguguuauaaacuggaaaggcaaagaacucaaauguggaaguggaaucuucgucaccaaugagguccauaccuggacagagcaauacaaauuccaagcagacucaccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaauacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccgugcaugccgacaugggcuacuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaacuacaggcccggguaccacacccagacggcgggacccuggcauuuaggaaaauuagaccuggacuucaacuauugcgaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaagaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagagggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuguuguuagagaggcaaucaagagacgucuaaggacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccaguuaggguuccaaauuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguagugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccaaccucucaauaaugaugaagaccacgcucacuggacagaagcaaaaaugcugcuggacaacauuaauacaccagaagggaucauaccagcucucuuugagccagaaagggagaagucagccgccauagacggugaguaucgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggccggcagaaagucaaucgcccuugaucuugugacagaaauaggaagagugccuucacaucuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaacuccccaagacaaccaacucgcauaugucgugauaggcauacucacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucaaaaaaggacagcugcuggaauaaugaagaauccaacgguggaugggauaaugacaauagaccuagaucccguaauauaugauucaaaauuugaaaaacaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauaaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaacaacacaucaugccguguccagagguaccgcgaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaucaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaagagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccaggcuaugcacaagggaagaguuuacaaaaaaggucagaaccaacgcagccaugggcgccguuuucacagaggagaaccaaugggauagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaaguccaguuaaucagacaaauggaaggagaaggugugcugucaaaggcagaccucgagaacccucaucugccagagaagaaaauuacacaaugguuggaaaccaaaggaguggagagguuaagaagaauggccauuagcggggaugauugcguagugaaaccaaucgaugacagguucgcuaaugcccugcuugcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguauggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7494 - RNA, 9873 nt, Artificial Sequence
  derived and/or modified CDS sequence (wt) from DENV-3__EU482558__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggauaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucuccugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacacaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagccauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7495 - RNA, 9873 nt, Artificial Sequence
  derived and/or modified CDS sequence (wt) from DENV-3__EU482563__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuguacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguauaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggcuguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuacuuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacaucgaacaaauggcaaauggaaucgcucuggggcucauggcucuuaaacugauaacacaauuugaaacauaccaauuauggacagcauuaaucuccuuaacguguucaaacacaaucuuuacgcugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcaacauuguuggucuggcacacuuggcaaaagcaaacccgaagauccggcguucuaugggauguaccuagcccuccagagacacagaaagcagaacuggaagaaggggucuauaggaucaaacagcaaggaaucuuugggaaaacccaaguagggguuggaguacagaaagaaggagucuuucacaccauguggcacguuacaagaggggcaguguuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguaguaggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguauauaucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcugcuggacaacauuaacacaccagaagguaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggagaucuggacaaaggaaggagagaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuugugugauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacagggccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucguaaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagauuaugcacaagggaagaguuuacaaaaaaggucagaacuaacgcagccaugggagccguuuucacagaggagaaccaaugggacagcgcgaaggcugcuguugaggaugaggacuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuuuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggagaagaucacacagcaaauggacccugaacacaggcagcuagcuaacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugacaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguugguaguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuauaugccuucaaugaagagauuuaggaaggaggaggagucggagggagccauuugguaa

SEQ ID NO: 7496 - RNA, 9873 nt, Artificial Sequence
  derived and/or modified CDS sequence (wt) from DENV-3__EU529696__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacauuggauauagagcuucagaagaccgaggccacccaauuggcgacucuaaggaaguuaugcauugaggggaaaauuaccaacauaacaacugacucaagauguccuacccaaggggaagcgguuuugccugaggagcaggaccagaacuacguguguaagcacacauacguggacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccucgggcuagaaugcucaccacggacagguuuggauuucaaugaaaugaucuugcuaacgaugaagaacaaagcauggaugguacauagacaaugguuuuuugaccuaccucugccauggacaucaggagcuacaacggaaacaccaaccuggaacaggaaggagcuucuugugacauuuaaaaacgcacaugcgaagaaacaagaaguaguuguucuuggaucgcaagagggagcaaugcauaccgcauugacaggagccacagaaauccaaaacucaggaggcacaaguauuuuugcggggcacuuaaaauguagacuuaagauggacaaauuggaacuuaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggagucauuacacucuaucugggagcuguggugcaagcugacaugggauguguuauaaacuggaaaggcaaagaacucaaauguggaaguggaaucuucgucaccaaugagguccauaccuggacagagcaauacaaauuccaagcagacucaccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaauacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccgugcaugccgacaugggcuacuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaacuacaggcccggguaccacacccagacggcgggacccuggcauuuaggaaaauuagaccuggacuucaacuauugcgaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaagaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggagucccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagagggggucuauaggaucaaacagcaaggaauuuuugggaaaacccaaguagggguuggaguacagaaagaaggagucuuccacaccauguggcacguuacacgaggggcgguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuguuguuagagaggcaaucaagagacgucuaaggacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccaguuaggguuccaaauuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguagugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccaaccucucaauaaugaugaagaccacgcucacuggacagaagcaaaaaugcugcuggacaacauuaauacaccagaagggaucauaccagcucucuuugagccagaaagggagaagucagccgccauagacggugaguaucgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggccggcagaaagucaaucgcccuugaucuugugacagaaauaggaagagugccuucacaucuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaacuccccaagacaaccaacucgcauaugucgugauaggcauacucacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucaaaaaaggacagcugcuggaauaaugaagaauccaacgguggaugggauaaugacaauagaccuagaucccguaauauaugauucaaaauuugaaaaacaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauaaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaacaacacaucaugccguguccagagguaccgcgaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaucaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaagagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccaggcuaugcacaagggaagaguuuacaaaaaaggucagaaccaacgcagccaugggcgccguuuucacagaggagaaccaaugggauagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaagaagaauggccauuagcggggaugauugcguagugaaaccaaucgaugacagguucgcuaaugcccugcuugcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguauggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauagguaaugaagaguuucuggacuacaugccuucaaugaagagauuuaggaaggaggaggagucggagggagccauuugguaa

SEQ ID NO: 7497 - RNA, 9873 nt, Artificial Sequence
  derived and/or modified CDS sequence (wt) from DENV-3__EU529697__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuguacuacuaaugcuggucaccccauccaugacaaugagaugugugggaguaggaaacagggauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcggcuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggcuguacaugccgacaugggcuauuggauagaaagccaaaagaauggaaguuggaagcuagaaaaagcaucccucauagaggugaaaaccugcacauggccaaaaucacauacccuuuggaguaaugguguguuagagagcgacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuacccaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacaucgaacaaauggcaaauggaaucgcucuggggcucauggcucuuaaacugauaacacaauuugaaacauaccaauuauggacagcauuaaucuccuuaacguguucaaacacaaucuuuacgcugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcaacauuguuggucuggcacacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaaccucaggaucuccuaucauaaacagagagggaaaaguaguaggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagagacguuuaagaacucuaauucuggcaccgacgagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguauauaucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggagaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuugugugauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuugaacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagauuauguacaagggaagaguuuacaaaaaaggucagaacuaaugcagccaugggagccguuuucacagaggagaaccaaugggacagugcgaaggcugcuguugaggaugaggacuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuuuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugacaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccauuuucaugaauugaucaugaaagauggaagaaaguugguaguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuaucggucucacuuccagagcaaccugggcccagaacauacccacagcaauucaacaggugagaagccuuauaggcaaugaagaguuucuggacuauaugccuucaaugaagagauuuaggaaggaggaggagucggagggagccauuugguaa

SEQ ID NO: 7498 - RNA, 9873 nt, Artificial Sequence
  derived and/or modified CDS sequence (wt) from DENV-3__EU482564__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacauuggauauagagcuucagaagaccgaggccacccaauuggcgacucuaaggaaguuaugcauugaggggaaaauuaccaacauaacaacugacucaagauguccuacccaaggggaagcgguuuugccugaggagcaggaccagaacuacguguguaagcacacauacguggacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccucgggcuagaaugcucaccacggacagguuuggauuucaaugaaaugaucuugcuaacgaugaagaacaaagcauggaugguacauagacaaugguuuuuugaccuaccucugccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacuuaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggagucauuacacucuaucugggagcuguggugcaagcugacaugggauguguuauaaacuggaaaggcaaagaacucaaauguggaaguggaaucuucgucaccaaugagguccauaccuggacagagcaauacaaauuccaagcagacucaccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaauacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccgugcaugccgacaugggcuacuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaacuacaggcccggguaccacacccagacggcgggacccuggcauuuaggaaaauuagaccuggacuucaacuauugcgaaggaacaacaguugucaucacagaaaacugugggacaagacgcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaagaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagagggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuguuguuagagaggcaaucaagagacgucuaaggacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccaguuaggguuccaaauuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguagugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccaaccucucaauaaugaugaagaccacgcucacuggacagaagcaaaaaugcugcuggacaacauuaauacaccagaagggaucauaccagcucucuuugagccagaaagggagaagucagccgccauagacggugaguaucgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggccggcagaaagucaaucgcccuugaucuugugacagaaauaggaagagugccuucacaucuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaacuccccaagacaaccaacucgcauaugucgugauaggcauacucacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucaaaaaaggacagcugcuggaauaaugaagaauccaacgguggaugggauaaugacaauagaccuagaucccguaauauaugauucaaaauuugaaaaacaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauaaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaacaacacaucaugccguguccagagguaccgcgaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaucaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaagagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccaggcuaugcacaagggaagaguuuacaaaaaaggucagaaccaacgcagccaugggcgccguuuucacagaggagaaccaaugggauagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaagaagaauggccauuagcggggaugauugcguagugaaaccaaucgaugacagguucgcuaaugcccugcuugcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguauggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7499 - RNA, 9873 nt, Artificial Sequence
  derived and/or modified CDS sequence (wt) from DENV-3__EU529699__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuauauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagaaggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccgucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguucuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccggagaagaaaauuacacaaugguuggaaaccaaaggaguggagagguuaaaaagaauggccauuaguggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauccaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauaccuacagcaauucaacaggugagaagccuuauaggcaaugaagaguuucuggacuacaugccuucaaugaagagauuuaggaaggaggaggagucggagggagccauuugguaa

SEQ ID NO: 7500 - RNA, 9873 nt, Artificial Sequence
  derived and/or modified CDS sequence (wt) from DENV-3__EU482566__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuacacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaaaaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucaaacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7501 - RNA, 9873 nt, Artificial Sequence
  derived and/or modified CDS sequence (wt) from DENV-3__EU529702__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuacggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacguaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacgugugcaagcauacauacguagacagaggcugggggaacggaugugguuuauuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacacagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagguuccuuucuccacagaggauggacaagggaaagcucacaauggcagacugaucacagccaacccaguggugacuaagaaggaggagccugucaauauugaggcugaaccuccuuuuggggaaaguaauauagugauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaucaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacuaaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgacauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucucaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugccuuguguuuggcaauccucuuugaagaggugaugagaggaaaauuugggaagaaacacaugauugcggggguuuucuuuacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuauuaggaguugggcuggcuauggcaacaacguuacaacugccagaggacauugaacaaauggcaaacggaaucgcucuggggcucauggcucucaaacugauaacacaauuugaaacauaccaguuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagggagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauugucagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacuguuugcgaaaaaacgggaaaaaggucauucaacuuagcaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaaggaaucauaccagcucucuuugagccagaaagggagaagucagccgccauagacggugaguaucgucugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuucuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccugugauauaugauucaaaauuugaaaagcaacugggacagguuaugcuccugguuuugugugcaguucaacuuuuauuaaugagaacaucaugggccuugugugaagcuuuaacucuagcuacaggaccaauaacaacacucugggaaggaucaccugggaaguuuuggaacaccacgauagcuguuuccauggcgaacaucuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuauaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaaguagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggguaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggacacuuguggacagagaacgugagcuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacagauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcgguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucagcaggugagaagccuuauaggcaaugaagaguuucuggacuacaugccuucaaugaagagauuuaggaaggaggaggagucggagggagccauuugguaa

SEQ ID NO: 7502 - RNA, 9873 nt, Artificial Sequence
  derived and/or modified CDS sequence (wt) from DENV-3__EU529703__SS-prME
acaucgcucugucucaugaugauauugccagcagcacuugcuuuccaccugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuacugaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcggcuuugccugaagagcaggaccagaacuacguguguaagcauacauacguggacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucgaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaaggaaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaagcaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguuuugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagacuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggccuggguaucacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccuuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcccuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgccccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaauugcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguucuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauacuauagagaauuccacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaaggcccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaucacggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuacauauuaagggacauuuccaagauacccggaggagccauguaugcugaugacacagccgguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucaggcaaauggaaggagaaggugugcugucaaaggcagaccucgagagccaucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucucaccacuuucaugaauugaucaugaaagauggaagaaaguuggugguucccugcagaccccaggacgaacuaauaggaagagcaagaauuucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaacguuccauaucuaggaaagagagaagaccaguggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7503 - RNA, 9873 nt, Artificial Sequence
  derived and/or modified CDS sequence (wt) from DENV-3__EU529705__SS-prME
acaucgcucugucucaugaugauacugccagcagcacucgcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaauaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagauagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacacagacaaugguuuuuugaccuaccucuaccauggacaucaggagcuacaacggaaacaccaaccuggaauaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauugggacucaaggggaugagcuaugcaaugugcacgaauaccuuuguguugaagaaagaagucucggaaacgcagcaugggacaauacucaucaaggucgaguacaaaggggaagauguaccuugcaagguuccuuucuccacagaggauggacaagggaaagcucacaguggcagacugauuacagccaacccaguggugacuaagaaggaggagccuguuaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaucaaauauucggaagugcuuacacagcccuauucaguggagucucuuggguaaugaaaauuggaauaggaauucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgacauaauuggggucuuagagcaaggaaaaagaacacuaacaccacaacccauggaacuaaaauacucauggaaagcguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggauccaacgcaucugacaggaugggaaugggcgucaccuaccuagcuuuaauugcaacauuuaaaauccagccauucuuggcuuugggauuuuuucuaagaaaacugacauccagagaaaauuuauuauuaggaguugggcuggcuauggcaacaacguuacaacugccagaggacauugaacaaauggcaaacggaaucgcucuggggcucauggcucuuaaacugauaacacaauuugaaacauaccaauuauggacagcauuaaucuccuuaacguguucaaauacaauuuucacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacuguuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuacucagauccccuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguagggccuacaggcaugcgguggaggaacuaccagagacaauggaaacacuucuacuccuaggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccugugauauaugauucaaaauuugaaaagcaacugggacagguuaugcuccugguuuugugugcaguucaacuuuuauuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuauaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacgaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaacauggugucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggguaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgagcgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcgguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucagcaggugagaagccuuauaggcaaugaagaguuucuggacuacaugccuucaaugaagagauuuaggaaggaggaggagucggagggagccauuugguaa

SEQ ID NO: 7504 - RNA, 9873 nt, Artificial Sequence
  derived and/or modified CDS sequence (wt) from DENV-3__EU596492__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuguacuacuaaugcuggucaccccauccaugacaaugagaugugugggaguaggaaacagggauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcggcuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuguaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggcuguacaugccgacaugggcuauuggauagaaagccaaaagaauggaaguuggaagcuagaaaaagcaucccucauagaggugaaaaccugcacauggccaaaaucacauacccuuuggaguaaugguguguuagagagcgacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacaucgaacaaauggcaaauggaaucgcucuggggcucauggcucuuaaacugauaacacaauuugaaacauaccaauuauggacagcauuaaucuccuuaacguguucaaacacaaucuuuacgcugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcaacauuguuggucuggcacacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaaccucaggaucuccuaucauaaacagagagggaaaaguaguaggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagagacguuuaagaacucuaauucuggcaccgacgagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguauauaucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggagaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuugugugauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuugaacaaaggauggccaauaucaaaaauggacuuaggaguaccccugcuggcauuagguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagauuauguacaagggaagaguuuacaaaaaaggucagaacuaaugcagccaugggagccguuuucacagaggagaaccaaugggacagcgcgaaggcugcuguugaggaugaggacuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuuuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugacaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacaugccucaauggcagccaucaaagggauggcaugauuggcagcagguuccuuucugcucccaccauuuucaugaauugaucaugaaagauggaagaaaguugguaguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuaucggucucacuuccagagcaaccugggcccagaacauacccacagcaauucaacaggugagaagccuuauaggcaaugaagaguuucuggacuauaugccuucaaugaagagauuuaggaaggaggaggagucggagggagccauuugguaa

SEQ ID NO: 7505 - RNA, 9873 nt, Artificial Sequence
  derived and/or modified CDS sequence (wt) from DENV-3__EU596493__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuguacuacuaaugcuggucaccccauccaugacaaugagaugugugggaguaggaaacagggauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggcuguacaugccgacaugggcuauuggauagaaagccaaaagaauggaaguuggaagcuagaaaaagcaucccucauagaggugaaaaccugcacauggccaaaaucacauacccuuuggaguaaugguguguuagagagcgacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacaucgaacaaauggcaaauggaaucgcucuggggcucauggcucuuaaacugauaacacaauuugaaacauaccaauuauggacagcacuaaucuccuuaacguguucaaacacaaucuuuacgcugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcaacauuguuggucuggcacacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauacaaugggaaaagacuggaaccaaacugggcuagcgugaaaaaagaucugauuucauacggaggaggauggagauugaacgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaaccucaggaucuccuaucauaaacagagagggaaaaguaguaggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagagacguuuaagaacucuaauucuggcaccgacgagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguauauaucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggagaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuugugugauugcuuccagcggcauguuguggauggccgaaaucccacuccaauggaucgcgucggccauaguccuggaguuuuuuaugaugguguugcuuauaccagaaccagagaagcagagaaccccccaagacaaccaacuugcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauuccugaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaauauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagauuauguacaagggaagaguuuacaaaaaaggucagaacuaaugcagccaugggagccguuuucacagaggagaaccaaugggacagcgcgaaggcugcuguugaggaugaggacuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuuuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugacaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccauuuucaugaauugaucaugaaagauggaagaaaguugguaguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuauaugccuucaaugaagagauuuaggaaggaggaggagucggagggagccauuugguaa

SEQ ID NO: 7506 - RNA, 9873 nt, Artificial Sequence
  derived and/or modified CDS sequence (wt) from DENV-3__EU596494__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuguacuacuaaugcuggucaccccauccaugacaaugagaugugugggaguaggaaacagggauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggauccacagaaauccaaaacucaggaggcacaagcauuuuugcggggcacuuaaaauguagacuuaagauggacaaauuggaacucaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggcuguacaugccgacaugggcuauuggauagaaagccaaaagaauggaaguuggaagcuagaaaaagcaucccucauagagguaaaaaccugcacauggccaaaaucacauacccuuuggaguaaugguguguuagagagcgacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacaucgaacaaauggcaaauggaaucgcucuggggcucauggcucuuaaacugauaacacaauuugaaacauaccaauuauggacagcauuaaucuccuuaacguguucaaacacaaucuuuacgcugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcaacauuguuggucuggcacacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaaccucaggaucuccuaucauaaacagagagggaaaaguaguaggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagagacguuuaagaacucuaauucuggcaccgacgagggugguugcagcugagauggaagaagcauuaaaagggcucccaauaagguaccaaacaacagcaacaagaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguauauaucaacucguguuggaaugggagaagcagccgcaauuuucaugacagcaacgcccccuggaacagcugacgccuuuccccagagcaacgcuccaauucaggaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggagaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggauaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuugugugauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugaugggucuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuauuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucaccgaaguggauagaacagaagccaaagaaggguugaaaagaggagaaauaacacaucaugccguguccagagguagcgcaaaacuucaaugguuuguggagagaaacauggucauuccugaaggaagaguuauagacuugggcuguggaagaggaggcuggucauauuacugugcaggacugaaaaaagucacagaagugcgaggauacacaaaaggcgguccaggacacgaagaaccagugccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagauuauguacaagggaagaguuuacaaaaaaggucagaacuaaugcagccaugggagccguuuucacagaggagaaccaaugggacagcgcgaaggcugcuguugaggaugaggacuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuuuuaaaugaagaccacugguucucgcgugagaacucuuacaguggaguggaaggagaaggacugcacaagcuaggcuauauauuaagggacauuucuaagauacccggaggagcuauguaugcugaugauacagcugguugggacacaagaauaacagaagaugaccugcacaaugaggaaaagaucacacagcaaauggacccugaacacaggcagcuagcgaacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugacaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccauuuucaugaauugaucaugaaagauggaagaaaguugguaguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacagaguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuauaugccuucaaugaagagauuuaggaaggaggaggagucggagggagccauuugguaa

SEQ ID NO: 7507 - RNA, 9873 nt, Artificial Sequence
  derived and/or modified CDS sequence (wt) from DENV-3__EU687218__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagaaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7508 - RNA, 9873 nt, Artificial Sequence
  derived and/or modified CDS sequence (wt) from DENV-3__EU726772__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuugggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagagucuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagggucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7509 - RNA, 9873 nt, Artificial Sequence
  derived and/or modified CDS sequence (wt) from DENV-3__FJ182013__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacguaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucauuacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugauuugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguuccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7510 - RNA, 9873 nt, Artificial Sequence
  derived and/or modified CDS sequence (wt) from DENV-3__EU781136__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuguaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggauaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaagauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacggugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaaguccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacgggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7511 - RNA, 9873 nt, Artificial Sequence
  derived and/or modified CDS sequence (wt) from DENV-3__EU781137__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuacacuacuaaugcuggucaccccauccaugacaaugagaugugugggaguaggaaacagagauuuuguagaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugcuucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguagccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucaaacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuauugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaagauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauuggucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7512 - RNA, 9873 nt, Artificial Sequence
  derived and/or modified CDS sequence (wt) from DENV-3__EU726773__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggggaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaaaggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggagugccccuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7513 - RNA, 9873 nt, Artificial Sequence
  derived and/or modified CDS sequence (wt) from DENV-3__EU726774__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagagguugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauucccuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugguuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugacaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacgauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccugcugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaacacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuagggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7514 - RNA, 9873 nt, Artificial Sequence
  derived and/or modified CDS sequence (wt) from DENV-3__EU687219__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauugccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugucucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaagcuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugauuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaccugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauacacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaaguacgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaggccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7515 - RNA, 9873 nt, Artificial Sequence
  derived and/or modified CDS sequence (wt) from DENV-3__EU726768__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucaucacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaacuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaggaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacuuuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggauuauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7516 - RNA, 9873 nt, Artificial Sequence
  derived and/or modified CDS sequence (wt) from DENV-3__EU687226__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgcuuugaaaaucaacugguacaagaagggaagcuccauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaauguuugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccgucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauagcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauugaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacucuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcacaagcaaacccaaagauccggcguuccaugggauguacccagcccuccagagacacagaaagcagaacuggaagaaggggucuauaggaucaaacagcaaggaauuuuugggaaaacccaaguagggguuggaguacagaaagaaggagucuuccacuccauguggcacguuacaagaggggcaguguugacauauaaugggaaaagacuggaaccaaacugggcuagcgugaagaaagaucugauuucauacggaggaggauggagauugagcgcacaauggcaaaagggggaggaggugcagguuauugccguagagccugggaagaacccaaagaacuuucaaaccaugccaggcacuuuucagaccacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauuaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguucuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccggagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauuaaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7517 - RNA, 9876 nt, Artificial Sequence
  derived and/or modified CDS sequence (wt) from DENV-3__EU687233__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauugccgaaguggaaccugaagacauugacugcuggugcaaccucacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggaccauggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacuguugccuggagaacagccacccugauuuuggccggaguuucgcuuuuaccagugugccagucuucgagcaugaggaaaucagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauccccgcaacauuguuggucuggcauacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccgauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacaugucacucaaacauggaagcccaguuaaucagacaaauggaaggagaaggugugcugucaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7518 - RNA, 9873 nt, Artificial Sequence
  derived and/or modified CDS sequence (wt) from DENV-3__EU687234__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacacagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagguuccuuucuccacagaggauggacaagggaaagcucacaguggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaucaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgacauaauuggggucuuagagcaaggaaaaagaacacuaacaccacaacccauggaacuaaaauacucauggaaaacguggggaaaggcaaaaauagugacagcugaaacacaaaauucuuccuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggauccaacgcaucugacaggaugggaaugggcgucaccuaccuagcuuuaauugcaacauuuaaaauccagccauucuuggcuuugggauuuuuucuaagaaaacugacauccagagaaaauuuauuauuaggaguugggcuggcuauggcaacaacguuacaacugccagaggacauugaacaaauggcaaacggaaucgcucuggggcucauggcucuuaaacugauaacacaauuugaaacauaccaauuauggacagcauuaaucuccuuaacguguucaaauacaauuuucacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacuguuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguagggccuacaggcaugcgguggaggaacuaccagagacaauggaaacacuucuacuccuaggacucaugaucuuguugacagguggagcaaugcuauucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccugugauauaugauucaaaauuugaaaagcaacugggacagguuaugcuccugguuuugugugcaguucaacuuuuauuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuauaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggguaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgagcgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcgguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucagcaggugagaagccuuauaggcaaugaagaguuucuggacuacaugccuucaaugaagagauuuaggaaggaggaggagucggagggagccauuugguaa

SEQ ID NO: 7519 - RNA, 9873 nt, Artificial Sequence
  derived and/or modified CDS sequence (wt) from DENV-3__EU687196__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaaaaccgaggccacccaacuggcgacccuaaggaagcuaugcauugaggggaaaauuaccaacauaacaacugacucaagaugucccacccaaggggaagcgguuuugccugaggagcaggaccagaacuacguguguaagcauacauacguagacagagguugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauucccuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacaguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucucucauagaggugaaaaccugcacauggccaaaaucacauacucuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuaucuucacguuuguacuccuucucucagggcaaauaacauggagagauguggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugacaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuaggaaugaugugcccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaccugauuucauacggaggaggauggagauugagcgcacaauggcaaaagggggaggaggugcagguuauugccguagagccugggaaaaauccaaagaacuuucaaaccaugccaggcauuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcagcgcaaaggagagggagaguuggcaggaacccacaaaaagaaaaugaccaguacauauucacgggccagccucucaacaaugaugaagaccaugcucacuggacagaagcaaaaaugcuacuggacaacauuaacacaccagaagggaucauaccagcucucuuugagccagaaagggagaagucagccgccauagacggugaguaucgccugaaaggugaguccaggaagaccuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauaugucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaacuagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagagggggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccugcugugugacauuggagaaucuucaccaagcccaacaguggaagaaagcagaacuguaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauauuucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuucuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagcuuuagagaaaccgcaugucuagggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7520 - RNA, 9873 nt, Artificial Sequence
  derived and/or modified CDS sequence (wt) from DENV-3__EU854298__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaauguccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaagguggucauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguugacagaggcugggggaacggaugugguuuguuuggcaagggaagcuugguaacaugugcgaaauuucaaugccuggaaccaauagagggaaaaguggugcaauaugagaaccucaaauacaccgucaucaucacggugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugccuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaaaugccucaagagcauggaaugugugggagguggaagauuacggguucggagucuucacaaccaacauauggcugaaacuccgagaggugcauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccuuuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccgccucuaccacuuuuuauuuuuagcuugaaagacacacucaaaaggagaagcuggccauugaaugaaggggugauggcuguugggcuugugagcauucuggccaguucucuccuuagaaaugauguacccauggcuggaccauuaguggccgggggcuugcugauagcgugcuacgucauaacuggcacaucagcagaccucaccguagaaaaagcagcagauguaacaugggaggaagaggcugagcaaacaggagugucccauaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuggcauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccauaccaggcacuuuucagacuacaacaggggaaauaggagcaauugcacuggauuucaagccuggaaccucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaacaaucaaauuuuagaagagaacauggacguggaaauuuggacaaaggaaggagaaaggaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcacacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggauugcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuugggaguaccccugcuggcauuggguugcuauucacaagugaacccacugacucuaacagcggcaguacucuugcugaucacacauuacgcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaagguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucacuaacauggaaguccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaucaggugagaagccuuauaggcaaugaagaguuucuggacuacaugccuucaaugaagagauuuaggaaggaagaggaguuggagggagccauuugguaa

SEQ ID NO: 7521 - RNA, 9873 nt, Artificial Sequence
  derived and/or modified CDS sequence (wt) from DENV-3__FJ373306__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacguaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccacuauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacgugugcaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacacagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagguuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaucaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgacauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucucaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuauuaggaguugggcuggcuauggcaacaacguuacaacugccagaggacauugaacaaauggcaaacggaaucgcucuggggcucauggcucucaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacuguuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgucugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuucuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccagugauauaugauucaaaauuugaaaagcaacugggacagguuaugcuccugguuuugugugcaguucaacuuuuauuaaugagaacaucaugggccuugugugaagcuuuaacucuagccacaggaccaauaacaacacucugggaaggaucaccugggaaguuuuggaacaccacgauagcuguuuccauggcgaacaucuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuauaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagagucuugaagaugguugaaccauggcuaaagaacaaccaauuuuguauuaaaguauugaacccuuacaugccaacugugauugagcaccuagaaagauuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggguaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugagcuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcgguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucagcaggugagaagccuuauaggcaaugaagaguuucuggacuacaugccuucaaugaagagauuuaggaaggaggaggagucggagggagccauuugguaa

SEQ ID NO: 7522 - RNA, 9873 nt, Artificial Sequence
  derived and/or modified CDS sequence (wt) from DENV-3__EU687197__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaagguggucauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagacugaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguugacagaggcugggggaacggaugugguuuguuuggcaagggaagcuugguaacaugugcgaaauuucaaugccuggaaccaauagagggaaaaguggugcaauaugagaaccuuaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaacaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuguaaacuggaaaggcaaagaacucaaauguggaaguggaaucuucgucaccaacgagguccauaccuggacagagcaauacaaauuccaagcagacuccccgaaaagauuggcgacagccauugcaggcgccugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucguggaaaacguggggaaaggcaaaaauagugacagcugaaacacaaaauucuucuuucauaauagauggaccaaacacaccggaguguccaaaugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccgccucuaccacuuuuuauuuuuagcuugaaagacacacucaaaaggagaagcuggccauugaaugaaggggugauggcuguugggcuugugagcauucuggccaguucucuccuuagaaaugauguacccauggcuggaccauuaguggccgggggcuugcugauagcgugcuacgucauaacuggcacaucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuggcauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaaccucaggaucucccaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaaggacucccaauaagguaccaaacaacagcaacaaaaucugaacacacaggaagagagauuguugaucugaugugccaugcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggagaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagauggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaacaaucaaauuuuagaagagaacauggauguggaaaucuggacaaaggaaggagaaaggaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcacuggacaaucuggugaugcugcacacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaaucgcuuccagcggcauguuguggauggccgaaaucccacuccaauggauugcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagcgagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuugggaguaccccugcuggcauuggguugcuauucacaagugaacccacugacucuaacagcggcaguacucuugcugaucacacauuacgcuauuauugguccaggauugcaggcaaaagccacucgugaagcucagaaaaggacagcugcuggaauaaugaagaauccaacgguggaugggauaaugacaauagaccuagaucccguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucaccgaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaagguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucacuaacauggaaguccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaucaggugagaagccuuauaggcaaugaagaguuucuggacuacaugccuucaaugaagagauuuaggaaggaagaggaguuggagggagccauuugguaa

SEQ ID NO: 7523 - RNA, 9873 nt, Artificial Sequence
  derived and/or modified CDS sequence (wt) from DENV-3__EU687198__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauugccgaaguggaaccugaagacauugacugcuggugcaaccucacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcacacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccagguaggaaaugaaacgcagggagucacggcugagauaacaccucaggcaucaaccacugaagccaucuuaccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaacuuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcggaaccuccuuuuggggaaaguaauauaguaauuggaguuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaaugggaucgcucuggggcucauggcucuuaaacugauaacacaauuugaaacauaccaauuauggacagcauuaaucuccuuaacguguucaaacacaaucuuuacguugacuguugccuggagaacagccacccugauuuuggccggaguuucgcuuuugccagugugccagucuucgagcaugaggaaaucagacuggcuuccaaugacaguggcagcuaugggaguuccaccucuaccacuuuuuauuuuuagcuugaaggacacacucaaaagaagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauccccgcaacauuguuggucuggcauacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggagugcagaaagaaggagucuuucacaccauguggcacguuacaagaggggcaguguuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuauauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccgauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuagacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggaaaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccugugauauaugauucaaaauuugaaaagcaacugggacagguuaugcucuugguuuugugugcaguucaacuucuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccaggucuaugccaggaacaagaaggguuauggggaucacagcggaguggcucuggagaacccugggaaggaacaaaaaacccagguuaugcacaagggaagaguucacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcggaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7524 - RNA, 9873 nt, Artificial Sequence
  derived and/or modified CDS sequence (wt) from DENV-3__EU726769__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccacuacauaggcacuuccuugacccagaaggugguuauuuuuauacuacuaaugcuggucaccccauccaugacaaugagaugugugggaguaggaaacagagauuuuguggaaggacuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaauaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgacauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagaguuuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugguugcggggguuuucuucacguuuguacuccuucucucagggcaaauaacauggagagauauggcgcacacacuaauaaugguuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugucagucuucgagcaugaggaaaacagacuggcuuccaaugacgguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuuacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagagcuggaagaaggggucuauaggaucaaacagcaaggaauuuuugggaaaacccaaguggggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacuuuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguucccagcauuaaagccggaaaugacauagcaaacugcuugcgaaaaaacgggaaaaaggucauucaacuuaguaggaagacuuuugauacagaauaucagaaaacuaaacugaaugauugggacuucguggugacgacugacauuucagaaaugggggccaauuucaaagcagauagagugaucgacccuagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugcccucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucaucuguguaauugcuuccagcggcauguuguggauagccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaauccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuucuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauuccugaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacggaacuccacgcacgaaauguacuggauaucuaauggcacagguaacauugucgcuucagucaacaugguaucuagacugcuacugaacagguucacgaugacauacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaagugggcaaguguggaagcuguguuuacaacaugaugggcaagagagagaagaaacuuggagaguuuggcaaagcaaaaggcaguagagcuauaugguacaugugguugggagccagguaccucgaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7525 - RNA, 9873 nt, Artificial Sequence
  derived and/or modified CDS sequence (wt) from DENV-3__EU687239__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauugccgaaguggaaccugaagacauugacugcuggugcaaccucacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggagguacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaguuggagacaacgccuugaaaaucaacugguacaagaagggaagcucuauugggaagauguuugaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacuguugccuggagaacagccacccugauuuuggccggaguuucgcuuuuaccagugugccagucuucgagcaugaggaaaucagacuggcuuccaaugacaguggcagcuaugggaguuccaccucuaccacuuuuuauuuuuagcuugaaagacacacucaaaagaagaaguuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauccccgcaacauuguuggucuggcauacuuggcaaaagcaaacccgaagauccggcguucuaugggauguaccuagcccuccagagacacagaaagcagaauuggaagaaggggucuauaggaucaaacagcaaggaauuuuugggaaaacccaaguagggguuggaguacagaaagaaggagucuuucacaccauguggcacguuacaagaggggcaguguuaacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaguugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccgauaagguaccaaacaacagcaacaaaaucugaacacacaggaagagagauuguugaucugaugugccacgcaacguucacaaugcgucugcugucaccaguuaggguuccaaacuauaauuugauaauaauggaugaagcccauuucacagacccagccaguauagcugcuagaggguacauaucaacucguguuggaaugggagaagcagccgcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggaaaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguuauauaugauucaaaauuugaaaagcaacugggacagguuaugcuccugguuuugugugcaguucaacuuuuguuaaugagaacaucaugggccuugugugaggcuuuaacucuagcuacaggaccaauaacaacacucugggaaggaucaccugggaaguuuuggaacaccacgauagcuguuuccauggcaaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccaggucuaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauuggguaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauugagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagucauuugguaa

SEQ ID NO: 7526 - RNA, 9873 nt, Artificial Sequence
  derived and/or modified CDS sequence (wt) from DENV-3__FJ182004__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgaaaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacaucgaacaaauggcaaauggaaucgcucuggggcucauggcucuuaaacugauaacacaauuugaaacauaccaauuauggacagcauuaaucuccuuaacguguucaaacacaaucuuuacgcugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcaacauuguuggucuggcacacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguaguaggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguauauaucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggagaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuugugugauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaggcugcuguugaggaugaggacuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugacaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguugguaguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuauaugccuucaaugaagagauuuaggaaggaggaggagucggagggagccauuugguaa

SEQ ID NO: 7527 - RNA, 9873 nt, Artificial Sequence
  derived and/or modified CDS sequence (wt) from DENV-3__FJ024465__SS-prME
acaucgcucugucucaugaugauauugccagcagcacuugcuuuccacuugacuucacgagauggagagccgcguaugauuguggggaagaaugaaagaggaaaaucccuacuuuuuaagacagccucuggaauuaacaugugcacacucauagccauggacuugggagagaugugugaugacacggucacuuacaaaugcccccacauugccgaaguggaaccugaagacauugacugcuggugcaaccucacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccccuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacucaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcggaaccuccuuuuggggaaaguaauauaguaauuggaauuggagacaacgccuugaaaaucaacugguacaagaagggaagcuccauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucauguauugcgauaggaaucauuacacucuaucugggagcuguggugcaagcugacacgggguguguuauaaacuggaaaggaaaagaacucaaauguggaaguggaaucuucgucaccaacgagguccauaccuggacagagcaauacaaauuccaagcagacuccccaaaaagauuggcaacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggcuguacaugccgacaugggcuauuggauagaaagccaaaagaauggaaguuggaagcuagaaaaagcaucccucauagaagugaaaaccugcacauggccaaaaucacauacccuuuggaguaaugguguguuagagagugacaugaucauuccaaagagucuagcugguccuaucucgcaacacaacuauaggcccggguaccacacccagacggcgggacccuggcauuuaggaaaauuagagcuggacuucaacuauugugaagggacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcgggcguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccaaccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaaucuuuacguugacuguugccuggagaacagccacccugauuuuggccggaguuucgcuuuuaccagugugccagucuucgagcaugaggaaaucagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugacguacccauggcuggaccauuaguggccgggggcuugcugauagcgugcuacgucauaacuggcacgucagcagaccucgccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuccagacuacaacaggggaaauaggagcaauugcacuggauuucaagccuggaacuucaggaucuccuaucauaaauagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuucagagggagcuauuuagcaggagcugggcuugcuuuuucuauuaugaaaucaguuggaacaggaaaaagaggaacaggcucacagggugaaacuuuaggagaaaaauggaagaagaaguuaaaucaauuaucccggaaagaguuugaccuuuacaagaaaucuggaaucacugaaguggauagaacagaagccaaagaaggguugaaaagaggagaaauaacacaucacgccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacggaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccacggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagauuaugcacaagggaagaguuuacaaaaaaggucagaacuaacgcagccaugggagccguuuucacagaggagaaccaaugggacagcgcaaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacucucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguccccugcagaccccaggacgaacuaauaggaagagcaagaaucucucaaggagcgggauggagccuuagagaaaccgcaugucuggggaaagccuacgcucaaauguggagucucauguauuuucacagaagagaucucagacuagcaucuaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7528 - RNA, 9873 nt, Artificial Sequence
  derived and/or modified CDS sequence (wt) from DENV-3__FJ024466__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccucacaucaacaugggugacuuauggaacgugcaaucaagccggagagcacagacgcgacaagagaucaguggcguuagcuccccaugucgguaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggacauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggagcucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcgaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauucucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacagauuccaagcagacuccccaaaaagauuggcaacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaagcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccuuauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagacaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacuuuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacuguugccuggagaacagccacccugaucuuggccggaguuucgcuuuuaccagugugccagucuucgagcaugaggaaaucagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauccccgcaacauuguuggucuggcauacuuggcaaaagcaaacccgaagauccggcguucuaugggauguacccagcccuccagagacacagaaggcagaacuggaagaaggggucuauaggaucaaacagcaaggaauuuuugggaaaacccaaguagggguuggaguacagaaagaaggagucuuucacaccauguggcacguuacaagaggggcaguguuaacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauuucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccaguauuaaagccggaaaugacauagcaaacugcuugcggaaaaacgggaaaaaggucauucaacuuagcaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagcgcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcacacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggaacauaauucaacauggcacuaugaugacgaaaaccccuacaaaaccugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaggcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacaucaaauggacccugaacacaggcagcuagcgaacgcuauauuuaagcucacauaccaaaauaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccccaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaccuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7529 - RNA, 9873 nt, Artificial Sequence
  derived and/or modified CDS sequence (wt) from DENV-3__FJ024467__SS-prME
acaucgcucugucucaugaugguauugccagcagcacuugcuuuccauuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuauaaaugcccccacauuaccgaaguggaaccugaagacauugacugcuggugcaaccuuacaucaacaugggugaccuauggaacgugcaaucaagccggagagcauagacgcgacaagagaucaguggcguuagcuccccaugucggcaugggauuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaauaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuccaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacucaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggagucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucucucauagaggugaaaaccugcacauggccaaaaucacauacccuuuggaguaacggugugcuagagagugacaugaucaucccaaagagucuagcugguccuauuucgcaacacaaccacaggcccggguaccaaacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagagaugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaauggguguuaccuaccuagcuuuaauugcagcauuuaaaauccagccauucuuggcuuugggauuuuuccuaagaaaacugacauccagagaaaauuuauuguuaggaguuggacuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcgcaauggcaaaagggggaggaggugcagguuauugccguagagccugggaagaacccaaagaacuuucaaaccaugccaggcacuuuccagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacgucuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccccagagcaacgcuccaauucaagaugaagaaaaggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcuguuggacaacauuaacacaccagaagggaucauaccagcucucuuugagccagaaagggagaaguccgccgccauagacggugaguaccgcuugaaaggugagucuaggaagacuuucguggaacucaugaggaggggugaccuuccagucugguuagcccauaaaguagcaucagaagggaucaaauacacagauagaaaauggugcuuugauggacaacguaauaaucaaauuuuagaggagaacauggauguggaaaucuggacaaaggaaggagaaaagaaaaaauugagacccagguggcuugaugcccgcacuuauucagaucccuuagcacucaaggaauucaaggacuuugcggcuggcagaaagucaaucgcccuugaucuugugacagaaauaggaagagugccuucacaucuagcccauagaacgagaaacgcucuggacaaucuggugaugcugcauacgucagaacauggugguagggcuuacaggcaugcgguggaggaacuaccagagacaauggaaacacuucuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacucacauuggcugcaauaauagcagccaaugaaaugggauuguuggaaacuacaaagagagauuuaggaaugucuaaggagccaggugucgucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauaaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaacaacacaucaugccguguccagagguacugcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaucaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacaggcaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaucauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggccauggggaucacagcggaguggcucuggagaaccuugggaaggaacaaaaaacccagguuaugcacaagggaagaguuuacaaaaaaggucagaacuaacgcagccaugggcgccguuuucacagaggagaaccaaugggauagcgcgaaagcugcuguugaggaugagaauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaacacauucaccaacauggaagcccaguuaaucagacaaauggaaggagaaggugugcugucaaaggcagaccucgagaacccucaucugccagagaagaagauuacacaaugguuggaaaccaaaggaguggagagguuaagaagaauggccauuagcggggaugauugcguagugaaaccaaucgaugacagguucgcuaaugcccugcucgcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacucauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7530 - RNA, 9873 nt, Artificial Sequence
  derived and/or modified CDS sequence (wt) from DENV-3__FJ024468__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaaguuaugcauugaggggaaaauuaccaacauaacaacugacucaagauguccuacccaaggggaagcgguuuugccugaggagcaggaccagaacuacguguguaagcacacauacguggacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccucgggcuagaaugcucaccacggacagguuuggauuucaaugaaaugaucuugcuaacgaugaagaacaaagcauggaugguacauagacaaugguuuuuugaccuaccucugccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggagucauuacacucuaucugggagcuguggugcaagcugacaugggauguguuauaaacuggaaaggcaaagaacucaaauguggaaguggaaucuucgucaccaaugagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccgugcaugccgacaugggcuacuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaagaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugauuacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagagggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccgaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacgucuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccagucaggguuccaaauuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccaaccucucaauaaugaugaagaccacgcucacuggacagaagcaaaaaugcugcuggacaacauuaauacaccagaagggaucauaccagcucucuuugagccagaaagggagaagucagccgccauagacggugaguaucgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaucuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaacuccccaagacaaccaacucgcauaugucgugauaggcauacucacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucaaaaaaggacagcugcuggaauaaugaagaauccaacgguggaugggauaaugacaauagaccuagaucccguaauauaugauucaaaauuugaaaaacaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauaaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaacaacacaucaugccguguccagagguaccgcgaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaucaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccaggcuaugcacaagggaagaguuuacaaaaaaggucagaaccaacgcagccaugggcgccguuuucacagaggagaaccaaugggauagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaagaagaauggccauuagcggggaugauugcguagugaaaccaaucgaugacagguucgcuaaugcccugcucgcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7531 - RNA, 9873 nt, Artificial Sequence
  derived and/or modified CDS sequence (wt) from DENV-3__FJ024470__SS-prME
acaucgcucugucucaugaugauauugccagcagcacuugcuuuccaccugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuacugaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcggcuuugccugaagagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucgaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggauaaauuggaacucaaaggaaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagacuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggccuggguaucacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccuuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcccuggggcucauggcucuuaaacugauaacacaauuugaaacauaucaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgccccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaauugcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguucuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauuccacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaaggcccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaucacggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuauaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuacauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucaggcaaauggaaggagaaggugugcugucaaaggcagaccucgagagccaucaucugccagagaagaagauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucucaccacuuucaugaauugaucaugaaagauggaagaaaguuggugguucccugcagaccccaggacgaacuaauaggaagagcaagaauuucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaacguuccauaucuaggaaagagagaagaccaguggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7532 - RNA, 9873 nt, Artificial Sequence
  derived and/or modified CDS sequence (wt) from DENV-3__FJ024471__SS-prME
acaucgcucugucucaugaugauauugccagcagcacuugcuuuccaccugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuacugaaguggaaccugaagacauugacugcuggugcaaccuuacaucaacaugggugacuuauggaacgugcaaucaagcuggagagcauagacgcgacaagagaucaguggcguuagcuccccaugucggcaugggacuagacacacgcacccaaacuuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcggcuuugccugaagagcaggaccagaacuacguguguaagcauacauacguggacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucgaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaaugcagacuuaagauggacaaauuggaacucaaaggaaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguuuugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagccgacaugggguguguuauaaacuggaaaggcaaagaacucaaauguggaaguggaaucuucgucaccaacgagguccauaccuggacagagcaauacaaauuccaagcagacuccccaaaaagacuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcagggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggccuggguaucacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccuuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcccuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugacgauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaagcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgccccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuuaacacagaauaucagaaaacuaaacugaaugauugggacuucguggugacaacugacauuucagaaaugggggccaauuucaaagcugauagagugaucgacccaagaagaugucucaaaccagugaucuugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaauugcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguucuuuaugaugguguugcuuauaccagaaccagaaaagcagagaaccccccaagacaaccaacucgcauaugucgugauaggcauacuuacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauacuauagagaauuccacagcaaaugugucucuggcagcuauagccaaccaggcagugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccagugccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaaggcccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaucacggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuacauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucaggcaaauggaaggagaaggugugcugucaaaggcagaccucgagagccaucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucucaccacuuucaugaauugaucaugaaagauggaagaaaguuggugguucccugcagaccccaggacgaacuaauaggaagagcaagaauuucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaacguuccauaucuaggaaagagagaagaccaguggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7533 - RNA, 9873 nt, Artificial Sequence
  derived and/or modified CDS sequence (wt) from DENV-3__FJ182005__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacacagacaaugguuuuuugaccuaccucuaccauggacaucaggagcuacaacggaaacaccaaccuggaauaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucggaaacgcagcaugggacaauacucaucaaggucgaguacaaaggggaagauguaccuugcaagguuccuuucuccacagaggauggacaagggaaagcucacaguggcagacugauuacagccaacccaguggugacuaagaaggaggagccuguuaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaucaaauauucggaagugcuuacacagcccuauucaguggagucucuuggguaaugaaaauuggaauaggaauucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggaguguguggaauuaggucaacaaccagaauggagaaucuccuguggaagcaaauagccaaugaacugaacuacauauugugggaaaacaauauuaaauuaacgguaguugugggcgacauaauuggggucuuagagcaaggaaaaagaacacuaacaccacaacccauggaacuaaaauacucauggaaagcguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggauccaacgcaucugacaggaugggaaugggcgucaccuaccuagcuuuaauugcaacauuuaaaauccagccauucuuggcuuugggauuuuuucuaagaaaacugacauccagagaaaauuuauuauuaggaguugggcuggcuauggcaacaacguuacaacugccagaggacauugaacaaauggcaaacggaaucgcucuggggcucauggcucuuaaacugauaacacaauuugaaacauaccaauuauggacagcauuaaucuccuuaacguguucaaauacaauuuucacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacuguuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuacucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguagggccuacaggcaugcgguggaggaacuaccagagacaauggaaacacuucuacuccuaggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccugugauauaugauucaaaauuugaaaagcaacugggacagguuaugcuccugguuuugugugcaguucaacuuuuauuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuauaagaaaucuggaauuacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggguaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgagcgcuauauuuaagcucacauaccaaaacaaaguggucaaaguucaacgaccgacuccaacaggcacgguaauggacaucauaucuaggaaagaccaaagaggcaguggacagguaggaacuuauggucugaacacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcgguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucagcaggugagaagccuuauaggcaaugaagaguuucuggacuacaugccuucaaugaagagauuuaggaaggaggaggagucggagggagccauuugguaa

SEQ ID NO: 7534 - RNA, 9873 nt, Artificial Sequence
  derived and/or modified CDS sequence (wt) from DENV-3__FJ373302__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacccaaaccuggaugucagcugaaggagcguggaggcaagucgagaagguagagacaugggcccuuaggcacccaggguucaccauacuagcccuauuucuugcccauuacauaggcacuuccuugacccagaaggugguuauauuuauacuacuaaugcuggucaccccauccaugacaaugagaugugugggagugggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagaggcguauacccaacuaugugaccauaggcuaaugucggcagccgucaaggaugagagggccguacaugccgacaugggcuauuggauagaaagccaaaagaaaggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcaacauuguuggucuggcacacuuggcaaaagcaaacccgaagauccggcguucuaugggauguaccuagcccuccagagacacagaaagcagaacuggaagaaggggucuauaggaucaaacaacaaggaauuuuugggaaaacccaaguagggguuggaguacagaaagaaggagucuuucacaccauguggcacguuacaagaggggcaguguuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacucaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaacgaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggagaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucaaagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaggcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugucagagaagaaaauuacacaaugguuggaaaccaaaggaguggagagguuaaaaagaauggccauuagcggggaugauugcguagugaaaccaaucgaugacagauucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuccuggacuacaugccuucaaugaagagauuuaggaaggaggaggagucggagggagccauuugguaa

SEQ ID NO: 7535 - RNA, 9873 nt, Artificial Sequence
  derived and/or modified CDS sequence (wt) from DENV-3__FJ182007__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacucaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagccacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaagcaacauaguaauuggaacuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuuaacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaagacugugggacaagaggcccaucauugagaacaacaacagugucagggaaguuaauacacgaaugguguugccgcucgugcacacuuccuccccugcgauacaugggagaagacgguugcugguauggcauggaaaucagacccauuagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguauuuuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggccauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcaacauuguuggucuggcacacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcagugcuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaacuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccacaaaguagcaucagaagggaucaaauauacagauagaaaauggugcuuugauggacaacguaauaaucaaauuuuagaagagaacauggauguggagaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuugugugauugcuuccagcggcauguuguggauagccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuagguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaggaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaggcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauaccuggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugucagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7536 - RNA, 9873 nt, Artificial Sequence
  derived and/or modified CDS sequence (wt) from DENV-3__FJ182008__SS-prME
acaucgcucuguaucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaccaagccggagagcacagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaaguuaugcauugaggggaaaauuaccaacauaacaacugacucaagauguccuacccaaggggaagcgguuuugccugaggagcaggaccagaacuacguguguaagcacacauacguggacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccucgggcuagaaugcucaccacggacagguuuggauuucaaugaaaugaucuugcuaacgaugaagaacaaagcauggaugguacauagacaaugguuuuuugaccuaccucugccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggagucauuacacucuaucugggagcuguggugcaagcugacaugggauguguuauaaacuggaaaggcaaagaacucaaauguggaaguggaaucuucgucaccaaugagguccauaccuggacagagcaauacaaauuccaagcagacucaccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccgugcaugccgacaugggcuacuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaagaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggccugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaauaucaggagucuuuccauacuccauacccgcaacauugcuggucuggcauacuuggcaaaagcaaacccaaagauccggcguucuaugggacguacccagccccccagagacacagaaagcagaacuggaagagggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacgucuaaggacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccaguuaggguuccaaauuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguagugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccaaccucucaauaaugaugaagaccacgcucacuggacagaagcaaaaaugcugcuggacaacauuaauacaccagaagggaucauaccagcucucuuugagccagaaagggagaagucagccgccauagacggugaguaucgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaucuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaacuccccaagacaaccaacucgcauaugucgugauaggcauacucacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucaaaaaaggacagcugcuggaauaaugaagaauccaacgguggaugggauaaugacaauagaccuagaucccguaauauaugauucaaaauuugaaaaacaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauaaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaacaacacaucaugccguguccagagguaccgcgaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaucaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccaggcuaugcacaagggaagaguuuacaaaaaaggucagaaccaacgcagccaugggcgccguuuucacagaggagaaccaaugggauagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaagaagaauggccauuagcggggaugauugcguagugaaaccaaucgaugacagguucgcuaaugcccugcuugcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguauggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7537 - RNA, 9873 nt, Artificial Sequence
  derived and/or modified CDS sequence (wt) from DENV-3__FJ182010__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuguacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaguagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggcuguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacaucgaacaaauggcaaauggaaucgcucuggggcucauggcucuuaaacugauaacacaauuugaaacauaccaauuauggacagcauuaaucuccuuaacguguucaaacacaaucuuuacgcugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcaacauuguuggucuggcacacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguaguaggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguauauaucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggagaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuugugugauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuggcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagauuaugcacaagggaagaguuuacaaaaaaggucagaacuaacgcagccaugggagccguuuucacagaggagaaccaaugggacagcgcgaaggcugcuguugaggaugaggacuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuuuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcggacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugacaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguugguaguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuauaugccuucaaugaagagauuuaggaaggaggaggagucggagggagccauuugguaa

SEQ ID NO: 7538 - RNA, 9873 nt, Artificial Sequence
  derived and/or modified CDS sequence (wt) from DENV-3__FJ182011__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccucacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggacauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuauuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggagcucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcgaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauucucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaagcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagacaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacuuuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacuguugccuggagaacagccacccugauuuuggccggaguuucgcuuuuaccagugugccagucuucgagcaugaggaaaucagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauccccgcaacauuguuggucuggcauacuuggcaaaagcaaacccgaagauccggcguucuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauuucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccaguauuaaagccggaaaugacauagcaaacugcuugcggaagaacgggaaaaaggucauucaacuuagcaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagcgccgcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcacacgucagaacauggcgguaaggccuacaggcaugcgguggaggaacuaccagagacaauggaaacacuucuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugaugggcuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuugggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggaacauaauucaacauggcacuaugaugacgaaaaccccuacaaaaccugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaggcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacaucaaauggacccugaacacaggcagcuagcgaacgcuauauuuaagcucacauaccaaaauaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaccuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7539 - RNA, 9873 nt, Artificial Sequence
  derived and/or modified CDS sequence (wt) from DENV-3__FJ182038__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaucaagccggagagcauagacgcgacaagagaucaguggcauuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaaguuaugcauugaggggaaaauuaccaacauaacaacugacucaagauguccuacccaaggggaagcgguuuugccugaggagcaggaccagaacuacguguguaagcacacauacguggacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccucgggcuagaaugcucaccacggacagguuuggauuucaaugaaaugaucuugcuaacgaugaagaacaaagcauggauggugcauagacaaugguuuuuugaccuaccucugccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuugugcugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacaacccuauucaguggagucucuuggguaaugaaaaucggaauaggaguucucuugacuuggauaggguugaauucaaaaaacacauccaugucauuuucaugcauugcgauaggagucauuacacucuaucugggagcuguggugcaagcugacaugggauguguuauaaacuggaaaggcaaagaacucaaauguggaaguggaaucuucgucaccaaugagguccauaccuggacagagcaauacaaauuccaagcagacucaccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggugauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccgugcaugccgacaugggcuacuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaagaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaacggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaacggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagagggggucuauaggaucaaacagcaaggaauuuuugggaaaacccaaguagggguuggaguacagaaagaaggagucuuccacaccauguggcacguuacaagaggggcgguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuaugucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacgucuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgccugcugucaccaguuaggguuccaaauuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccggaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguagugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucaugggccaaccucucaauaaugaugaagaccacgcucacuggacagaagcaaaaaugcugcuggacaacauuaauacaccagaagggaucauaccagcucucuuugagccagaaagggagaagucagccgccauagacggugaguaucgcuugaaaggugaaucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaucuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaacuccccaagacaaccaacucgcauaugucgugauaggcauacucacauuggcugcaacaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucaaaaaaggacagcugcuggaauaaugaagaauccaacgguggaugggauaaugacaauagaccuagaucccguaauauaugauucaaaauuugaaaaacaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauaaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaacaacacaucaugccguguccagagguaccgcgaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaucaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccaggcuaugcacaagggaagaguuuacaaaaaaggucagaaccaacgcagccaugggcgccguuuucacagaggagaaccaaugggauagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaagaagaauggccauuagcggggaugauugcguagugaaaccaaucgaugacagguucgcuaaugcccugcucgcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7540 - RNA, 9873 nt, Artificial Sequence
  derived and/or modified CDS sequence (wt) from DENV-3__FJ182041__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauugccgaaguggaaccugaagacauugacugcuggugcaaccucacaucaacaugggugacuuauggaacgugcaaucaagccggagagcacagacgcgacaagagaucaguggcguuggcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuuuaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcggaaccuccuuuuggggaaaguaauauaguaauuggaauuggagacaacgccuugaaaaucaacugguacaaaaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacugucgccuggagaacagccacccugauuuuggccggaguuucgcuuuuaccagugugccagucuucgagcaugaggaaaucagacuggcuuccaaugacaguggcagcuaugggaguuccaccguuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacacuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacgucacaagaggggcaguguuaacauauaaugggaaaagacuggaaccaaacugggcuagcgugaaaaaagaucugauuucauacggaggaggauggagauugagcgcgcaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccgguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccccaaagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcccacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccaguuauuuagauguggauuugcacccagcaucagccuggacauuguaugcuguggccaccacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcacacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguuucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcugcguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagccucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccaguuacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaaaagauuuaggaaggaggaggagucggagggagccauuugguaa

SEQ ID NO: 7541 - RNA, 9873 nt, Artificial Sequence
  derived and/or modified CDS sequence (wt) from DENV-3__FJ390371__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccuuacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugaccaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacuguugccuggagaacagccacccugauuuuggccggaguuucgcuuuuaccagugugccagucuucgagcaugaggaaaucagacuggcuuccaaugacaguggcagccaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuauuaauaguaucaggaaucuuuccauacuccauccccgcgacauuguuggucuggcacacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauacaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugacgccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuggcccauaaaguagcaucagaagggaucaaauauacagauagaaaauggugcuuugauggacaacguaauaaucaaauuuuagaagagaacauggauguggagaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuucacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggggcaaugcuuuucuuaauaucagguaaagggauuggaaagacuucaauaggacucauuugugugauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaggcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccagaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugacaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguugguaguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7542 - RNA, 9873 nt, Artificial Sequence
  derived and/or modified CDS sequence (wt) from DENV-3__FJ390372__SS-prME
acaucgcucugucucaugaugguauugccagcagcacuugcuuuccauuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaucaagccggagagcauagacgcgacaagagaucaguggcguuagcuccccaugucggcaugggauuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuccaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacucaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggagucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggaguuuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucucucauagaggugaaaaccugcacauggccaaaaucacauacccuuuggaguaacggugugcuagagagugacaugaucaucccaaagagucuagcugguccuauuucgcaacacaaccacaggccuggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaauggguguuaccuaccuagcuuuaauugcaacauuuaaaauccagccauucuuggcuuugggauuuuuccuaagaaaacugacauccagagaaaauuuauuguuaggaguuggacuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcgcaauggcaaaagggggaggaggugcagguuauugccguagagccugggaagaacccaaagaacuuucaaaccaugccaggcacuuuccagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacgucuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccccagagcaacgcuccaauucaagaugaagaaaaggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagacagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcuguuggacaacauuaauacaccagaagggaucauaccagcucucuuugagccagaaagggagaaguccgccgccauagacggugaguaccgcuugaaaggugagucuaggaagacuuucguggaacucaugaggaggggugaccuuccagucugguuagcccauaaaguagcaucagaagggaucaaauacacagauagaaaauggugcuuugauggacaacguaauaaucaaauuuuagaggagaacauggauguggaaaucuggacaaaggaaggagaaaagaaaaaauugagacccagguggcuugaugcccgcacuuauucagaucccuuagcacucaaggaauucaaggacuuugcggcuggcagaaagucaaucgcccuugaucuugugacagaaauaggaagagugccuucacaucuagcccauagaacgagaaacgcucuggacaaucuggugaugcugcauacgucagaacauggugguagggcuuacaggcaugcgguggaggaacuaccagagacaauggaaacacuucuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacucacauuggcugcaauaauagcagccaaugaaaugggauuguuggaaacuacaaagagagauuuaggaaugucuaaggagccaggugucgucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauaaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaacaacacaucaugccguguccagagguaccgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaucaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacaggcaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccaccagagagucuuuaaagagaaaguggacaccaggacacccagguccaugccaggaccaagaagggccauggggaucacagcggaguggcucuggagaaccuugggaaggaacaaaaaacccagguuaugcacaagggaagaguuuacaaaaaagggcagaacuaacgcagccaugggcgccguuuucacagaggagaaccaaugggauagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugccacagcugguugggacacaagaauaacagaagaugaccugcacaaugaggaaaagaucacacagcaaauggacccugaccacaggcaguuagcgaccgcuauauuuaagcucacauaccaaaacaaaguggucaaaguucaacgaccgacuccaacaggcacgguaauggacaucauaucuaggaaagaccaaagaggcaguggacagguaggaacuuauggucugaacacauucaccaacauggaagcccaguuaaucagacaaauggaaggagaaggugugcugucaaaggcagaccucgagaacccucaucugccagagaagaaaauuacacaaugguuggaaaccaaaggaguggagagguuaagaagaauggccauuagcggggaugauugcguagugaaaccaaucgaugacagguucgcuaaugcccugcucgcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7543 - RNA, 9873 nt, Artificial Sequence
  derived and/or modified CDS sequence (wt) from DENV-3__FJ205870__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccucacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggugcuugggagaauggaguguguggaauuaggucaacgaccagaauggagaaucuccuguggaagcaaauagccaaugaacugaacuacauauugugggaaaacaauaucaaauuaacgguaguugugggcgauauaauugggaucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaauuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacuguugccuggagaacagccacccugauuuuggccggaguuucgauuuuaccagugugccagucuucgagcaugaggaaaucagacuggcuuccaaugacaguggcagcuaugggaguuccaccucuaccacuuuuuauuuuuagcuugaaagacacacucaaaagaagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauccccgcaacauuguuggucuggcauacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccgauaagguaccaaacaacagcaacaaaaucugaacacacaggaagagagauuguugaucugaugugccacgcaacguucacaaugcgucugcugucaccagucaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggaaaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuagaaacuacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagcuacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguacccauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccaggucuaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcccaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7544 - RNA, 9873 nt, Artificial Sequence
  derived and/or modified CDS sequence (wt) from DENV-3__FJ390373__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagaacuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagagguugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccccaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauacugcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauucccuucuccacagaggauggacgagggaaagcucacaauggcagacugauuacagccaacccaguggugacuaagaaggaggagccugucaauauugaagcugaaccuccuuuuggggaaaguaauauaguaauuggaauuggagacaaugccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggagugugcggaauuaggucaacaaccagaauggagaaucuccuguggaagcaaauagccaaugaauugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguagucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugacaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacuguggcagcuaugggaguuccaccucuaccacuuuuuauuuuuagcuugaaagacacacucaaaaggagaagcuggccacugaaugaaggggugauggcuguugggcuugugagcauccuggccaguucucuccuuagaaaugauguacccauggcaggaccauuaguggccgggggcuugcugauagcgugcuacgucauaacuggcaccucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuucugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacgucacaagaggggcaguguugacauauaaugggaaaagacuggaaccaaacugggcuagcgugaaaaaagaucugaucucauacggaggaggauggagauugagcgcacaauggcaaaagggggaggaggugcagguuauugccguagagccugggaagaacccaaagaacuuucaaaccaugccaggcaccuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaggagauguucaaaaagcgaaaucuaaccauaauggaucuucauccugggucaggaaagacacggaaauaccuuccagccauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagaucguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcuacuggacaacauuaacacaccagaagggaucauaccagcucucuuugagccagaaagggagaagucagccgccauagacggugaguaucgccugaaaggugaguccaggaagacuuucguggaacucaugaggaggggugcccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaagauggauuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccugcugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuccaaaggaaacauggaggaaugcuugugagaaauccacuuucacgaaacuccacgcacgaaauguacuggauaucuaauggcacagguaacauugucgcuucagucaacaugguauccagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcagcagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgccauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauuguguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuagggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccguggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7545 - RNA, 9873 nt, Artificial Sequence
  derived and/or modified CDS sequence (wt) from DENV-3__FJ205871__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagagguugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauucccuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagaggcguauacccaacuaugugaccauaggcuaaugucggcagccgucaaggaugagagggccguacaugcugacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugacaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccugcugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuagggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcgguucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7546 - RNA, 9873 nt, Artificial Sequence
  derived and/or modified CDS sequence (wt) from DENV-3__FJ390375__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagagguugggggaacggaugugguuuguuuggcaagggaagcuugguaacaugugcgaaauuucagugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauucccuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugacaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccagcauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccugcugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggauauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuagggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7547 - RNA, 9873 nt, Artificial Sequence
  derived and/or modified CDS sequence (wt) from DENV-3__FJ390376__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuacacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugcuucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagagagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaauauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguagccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucaaacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuauugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaagauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7548 - RNA, 9873 nt, Artificial Sequence
  derived and/or modified CDS sequence (wt) from DENV-3__FJ390377__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuacacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacauggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucucucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguagccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucaaacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucugcauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuauugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaagauguguuuuaucuuccaccugaaaagugugacacccuguugugugacauuggagaaucuucaccaagcccaacaguggaagaaagcagaaccauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgccauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagauucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7549 - RNA, 9873 nt, Artificial Sequence
  derived and/or modified CDS sequence (wt) from DENV-3__FJ547069__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacuuaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuuacugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaccaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7550 - RNA, 9873 nt, Artificial Sequence
  derived and/or modified CDS sequence (wt) from DENV-3__FJ562107__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacacagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaucaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagccuauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7551 - RNA, 9873 nt, Artificial Sequence
  derived and/or modified CDS sequence (wt) from DENV-3__FJ547071__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcgcuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacgcuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacagugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcauggcacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaaguuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagaugguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcgggaguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacggcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaaacagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagugugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuuuacggacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggguggccaauaucaaaaauggacuugggaguaccccugcuggcauugggaugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugauuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaccaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauauacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuauaugccaacugugauugagcaccuagaaagacuacaaaggaaacauggaggaaugcuugugagaaauccacuuucacgaaacuccacgcacgaaauguacuggauaucuaauggcacagguaacauugucgccucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaauucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacucauuggucucacuuccagagcaacuugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7552 - RNA, 9873 nt, Artificial Sequence
  derived and/or modified CDS sequence (wt) from DENV-3__FJ410176__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagaacuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagagguugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauucccuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcucaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguucucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugacaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcuacuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccugcugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguauccagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauuguguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuagggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7553 - RNA, 9873 nt, Artificial Sequence
  derived and/or modified CDS sequence (wt) from DENV-3__FJ410177__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagaacuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagagguugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauucccuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaggagggccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugacaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacguuagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcuacuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaggucaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccugcugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguauccagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaagagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauuguguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuagggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7554 - RNA, 9873 nt, Artificial Sequence
  derived and/or modified CDS sequence (wt) from DENV-3__FJ547072__SS-prME
acaucgcucugucucaugaugauacugccagcagcacuugcuuuccacuugacuucacgagauggagagccgcgcaugauuguggggaagaaugaaagaggaagaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucaucacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacuuuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuugggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7555 - RNA, 9873 nt, Artificial Sequence
  derived and/or modified CDS sequence (wt) from DENV-3__FJ547073__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucuaaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacauggguuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacuuuaauucuggcaccgacaagggugguugcagcugagauggaagaagcauugaaagggcucccaauaagguaccaaacaacagccacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuucgacacagaauaucagaaaacuaaacugaaugauugggacuucguggugacgacugacauuucagaaaugggggccaauuucaaagcagauagagugaucgacccaagaagaugucucaaaccagugauccugacagauggaccggagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaauaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacagguaugcgguggaggaacuaccagagacaauggaaacacuccuacuccugggacucaugaucuuguugacagguggagcaaugcucuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacauggugucuagacugcuacugaacagguucacgaugacacacagaagaccuaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacaugggcuuaccacggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggauagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaacacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7556 - RNA, 9873 nt, Artificial Sequence
  derived and/or modified CDS sequence (wt) from DENV-3__FJ547074__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagaguuuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugucagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuuacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacuuuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccugcuggcauuggguugcuauucacaagugaauccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggaaagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacauacagaagacccaccauugagaaagaugugguuuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauauuuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7557 - RNA, 9873 nt, Artificial Sequence
  derived and/or modified CDS sequence (wt) from DENV-3__FJ547075__SS-prME
acaucgcuuugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauucucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaauugcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugucagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaucagauggaccgacaccagaauuggaagaagagauguucaaaaagcgaaaucuaaccauaauggaucuucauccugggucaggaaagacacggaaauaccuuccagccauuguuagagaggcaaucaagagacguuuaagaacuuuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucagccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaauccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauauuuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7558 - RNA, 9873 nt, Artificial Sequence
  derived and/or modified CDS sequence (wt) from DENV-3__FJ547076__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagcuacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgcuuugaaaaucaacugguacaagaagggaagcuccauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcaucgcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaauguuugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccgucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauagcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauugaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacucuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcacacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaagaaagaucugauuucauacggaggaggauggagauugagcgcacaauggcaaaagggggaggaggugcagguuauugccguagagccugggaagaacccaaagaacuuucaaaccaugccaggcacuuuucagaccacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauuaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccgucuccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguucuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccggagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauuaaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7559 - RNA, 9873 nt, Artificial Sequence
  derived and/or modified CDS sequence (wt) from DENV-3__FJ547077__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcugguguaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuucauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccauuuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugaucuuggccggaguuucgcuuuuaccagugugccagucuucgagcaugaggaaaacagacuggcuuccaaugacaguggcagcuaugggaguuccaccucuaccacuuuucauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccaguggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaacaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuugggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauacuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcaugaaauguauuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaauuaauaggaagagcaagaaucucucaaggagcgggauggagccuuagagaaaccgcaugucuggggaaagccuacgcucaaauguggaaucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7560 - RNA, 9873 nt, Artificial Sequence
  derived and/or modified CDS sequence (wt) from DENV-3__FJ547078__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccacuacauaggcacuuccuugacccagaaggugguuauuuuuauacuacuaaugcuggucaccccauccaugacaaugagaugugugggaguaggaaacagagauuuuguggaaggccuaucaggagccacguggauugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucauuaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaacaugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaauauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggccgagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccaacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugccagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugauauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacuuauuuguguaauugcuuccagcggcauguuguggauggccgaaauuccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagccauagccaaccaggcagugguccugauggguuuggacaaaggauggccaauaucaaaaauggacuugggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaauccucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccuuuuggccagcagagagucuuuaaagagaaaguggacaccaggacacccaaguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7561 - RNA, 9873 nt, Artificial Sequence
  derived and/or modified CDS sequence (wt) from DENV-3__FJ547079__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagccacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcuaaauuucaaugccuggaaccaauagagggaaaaguggugcaauaugagaaccucaaauacaccgucaucaucacagugcacacaggagaccaacaccaggugggaaaugaaacacagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacauggggugugucauaaacuggaaaggcaaagaacucaaauguggaaguggaaucuucgucaccaacgagguccauaccuggacagagcaauacaaauuccaagcagacuccccaaaaagauuggcgacagccaucgcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaaguuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuucuuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguuggacuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaaaacagcauuacuaauaguaucaggaaucuuuccauacuccauacccgcaacauuguuggucuggcauacuuggcauaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacccuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccggucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaaucuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuugggaguaccccugcuggcauuggguugcuauucacaaguaaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguucggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagagguaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguagagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaguugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacucauuggucucacuuccagggcaaccugggcccagaacauacccacagcaauucaacaggugagaagccuuauaggcaaugaagaguuucuggacuacaugcccucaaugaagagauuuaggaaggaggaggagucggagggagccauuugguaa

SEQ ID NO: 7562 - RNA, 9873 nt, Artificial Sequence
  derived and/or modified CDS sequence (wt) from DENV-3__FJ547080__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaacaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauacugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucucaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagccauuguuagagaagcaaucaagagacguuuaagaacuuuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacgaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaaggcauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucuuacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7563 - RNA, 9873 nt, Artificial Sequence
  derived and/or modified CDS sequence (wt) from DENV-3__FJ547081__SS-prME
acaucgcucugucucaugaugauauugccagcagcacuugcuuuccacuugacuucacgagauggagagccgcgcaugaucguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcggucuugccugaggagcaggaccagaacuacguguguaagcauacauacguagacagaggcugggggaacgggugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccucggaucgcaagagggagcaaugcauaccgcauugacaggagccacagaaauccaaaacucaggaggcacaagcauuuuuucggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagaugggccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucaugacucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcguuugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguugguaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauaugcagauagaaaauggugcuuugauggacaacguaauaaucaaauuuuagaggagaacauggauguggaaaucuggacaaaggaaggagaaaagaaaaaauugagaccuagauggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuucaaccagcuauuuagauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacaggcaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggacuuuuggaaacuuguggacagagaacgugaacuccacaaauugggcaaguguggaagcuguguauacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauagucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggaugaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcagugccaguccacuggguccccacaaguagaacgacauggucuauucaugcucaccaucaguggaugaccacagaagacaugcuuacugucuggaacaggguguggaucgaggacaauccauggauggaagacaaaacuccaguuacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggaaucggagggagccauuugguaa

SEQ ID NO: 7564 - RNA, 9873 nt, Artificial Sequence
  derived and/or modified CDS sequence (wt) from DENV-3__FJ547082__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauugccgaaguggaaccugaagacauugacugcuggugcaaccucacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaauguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacuguugccuggagaacagccacccugauuuuggccggaguuucgcuuuuaccagugugccagucuucgagcaugaggaaaucagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcccacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccacaaaguagcaucagaagggaucaaauauacagauagaaaauggugcuuugauggacaacguaacaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuuguaacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauacuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacgggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugucagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7565 - RNA, 9873 nt, Artificial Sequence
  derived and/or modified CDS sequence (wt) from DENV-3__FJ547083__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguuuaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagacagaggccacccaauuggcgacccuaaggaagcuaugcauugaggggaaaauuaccaacauaacaacugacucaagauguccuacccaaggggaagcgguuuugccugaggagcaggaccagagcuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuuuacaaugggugucuuguguuuggcaauccucuuugaagaggugaugagaggaaaauuugggaagaaacacaugauugcggggguuuucuucacguuugugcuccuucucucagggcaaauaacauggagagacauggcacacacacuaauaaugauuggguccagcgcaucugacaggaugggaaugggcguuaccuaccuagcuuuaauugcaacauuuaaaauccagccauucuuggcucugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaaggguaguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacuaaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaacgaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuucuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaaguaaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaaccuuaggagaaaaauggaaaaagaaauugaaucaauuaucccggaaagaguuugaccuuuacaagaaaucuggaaucacugaaguggauagaacagaagccaaagaaggguugaaaagaggagaaauaacacaucaugccguguccagagguagcgcgaaacuucaaugguuuguggagagaaacauggucauucccgaaggaagagucauagacuugggcuguggaagaggaggcuggucauauuacugugcaggacuaaaaaaagucacagaagugcgaggauacacaaaaggcgguccaggacacgaagaaccaguacccauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacacacgaaauguacuggauaucuaauggcacagguaacauugucgcuucagucaauaugguaucuagacugcuacugaacagguucacgaugacacacagaagacccaccauugagaaagauguggauuuaggagcaggaacucgacaugucaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaagugguuaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaaucacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcucacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7566 - RNA, 9873 nt, Artificial Sequence
  derived and/or modified CDS sequence (wt) from DENV-3__FJ547084__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagaacuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagagguugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccccaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauucccuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaggggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggagugugcggaauuaggucaacaaccagaauggagaaucuccuguggaagcaaauagccaaugaauugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacucuuuggaguaaugguguguuagagagugacaugaucauuccaaagagucuagcuggcccuaucucgcaacacaacuacaggcccggguaccacacccagacggcgggacccuggcauuuaggaaaauuagagcuggacuucaacuauugugaaggaacaacaguagucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauuguggggguuuucuucacguuuguacuccuucucucagggcaaauaacauggagagauauggcgcacacacuaauaaugaucggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugacaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcaccucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagguugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaauuuaaccauaauggaucuucauccugggucaggaaagacacggaaauaccuuccagccauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcuacuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacaagaaacgcucuggacaaucuggugaugcugcauacgucagaacauggcgguaaggccuacaggcaugcgguggaggaacuaccagagacaauggaaacucuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaaccacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaagauggauuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacaggucaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccugcugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguauccagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacauaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauuguguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuagggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccguggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7567 - RNA, 9873 nt, Artificial Sequence
  derived and/or modified CDS sequence (wt) from DENV-3__FJ478456__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuuaggagagaugugugaugacacggucacuuacaaaugcccccacauugccgaaguggaaccugaagacauugacugcuggugcaaccucacaucaacaugggugacuuauggaacgugcaaucaagccggagagcacagacgcgacaagagaucaguggcguuagcuccccaugucggcaugggacuggacacacgcacccaaaccuggaugucagcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcggaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcaacagccauugcaggugcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaauuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaaucuuuacguugacuguugccuggagaacagccacccugauuuuggccggaguuucgauuuuaccagugugccagucuucgagcaugaggaaaucagacuggcuuccaaugacaguggcagcuaugggaguuccaccucuaccacuuuuuauuuuuagcuugaaagacacacucaaaagaagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauccccgcaacauuguuggucuggcauacuuggcaaaagcaaacccgaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguuaacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccgauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggaaaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuagaaacuacaaagagagauuuaggaaugucuaaggagccagguguuguuucuccaaccaguuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagcuacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccaggucuaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcagcuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7568 - RNA, 9873 nt, Artificial Sequence
  derived and/or modified CDS sequence (wt) from DENV-3__FJ547085__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggauacacgcacccaaacuuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacugcuaaugcuggucaccccauccaugacaaugagaugugugggaguaggaaacagagauuuuguggaaggacuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccaaaacuacguguguaagcauacauacguagacagaggcugggggaacggaugugguuuguuugguaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguucuugggucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacuuaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcaauaggaaucaucacacucuaucugggagcuguggugcaagcugacacgggguguguuauaaacuggaaaggcaaagaacucaaguguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauugacgguuguugugggcgauauaauuggggucuuagagcaagggaaaagaacacuaacaccacaacccauggagcuaaaauacucauggaaaacguggggaaaggcaagaauagugacagcugaaacacaaaauucuucuuucauaauagauggaccaaauacaccggaguguccaaauaccucaagagcauggaaugugugggagguggaagauuacggguucggagucuucacaaccaacauauggcugaaacuccgagagguguauacccaacuaugugaccauaggcuaaugucggcagccgucaaggaugaaagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggaccuuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaaugcaacugacaggaugggaaugggcgucaccuaccuagcuuuaauugcaacauuuaaaauccagccauuuuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggcuggaguuucacuuuuaccagugugucagucuucgaguaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagcccggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccaacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauauucaugacagcaacgcccccuggaacagcugaugccuuuccccagagcaacgcuccaauucaagaugaagaaagggacauaccagaacgcucauggaauucaggcaaugaauggauaacugacuucgcugggaaaacggugugguuuguccccagcauuaaagccggaaaugacauagcaaauugccugcggaaaaacgggaaaaaggucauucaacuuaguaggaagacuuuugacacagaauaucagaaaaccaaacugaaugauugggacuuuguggugacaacugacauuucagaaaugggggccaauuucaaagcagauagagugaucgacccaagaagaugucucaaaccagugauccugacagauggaccagagcgggugauccuggcuggaccaaugccagucaccgcagcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcucgcaccuauucagaucccuuagcacucaaggaauucaaggacuuugcggcuggcagaaagucaauagcccuugaucuugugacagaaauaggaagagugccuacacaccuagcucauagaacgagaaacgcccuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguugagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuacgccauuauagguccaggauugcaggcaaaagccacccgugaagcucagaaaaggacagcugcuggaauaaugaagaauccaacaguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacccuagcuacaggaccaauaacaacacucugggaaggaucaccugggaaguuuuggaacaccacgauagcuguuuccauggcgaacauuuuuagagggagcuauuuagcaggagcugggcuugcuuucucuauuaugaaaucaguuggaacagggaaaagaggaacaggcucacagggugaaacuuugggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguacugcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccagcugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggagaucacagcggaguggcucuggagaacccugggaaggaauaaaaaacccagguuaugcacaagggaagaguuuacaaaaaaggucagaacuaacgcagccaugggagcuguuuucacagaggagaaccaaugggacagcgcgaaagcugcuguugaggaugaggauuuuuggaaacuuguggacagagaacgugaacuccacaaacugggcaaguguggaagcuguguuuacaacaugauggguaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggauaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcucaaauguggagucucauguauuuucacagaagagaccucagacuagcauccaacgccauauguucagcaguaccaguccacuggguccccacaaguagaacgacauggucuauucacgcucaccaucaguggaugaccacagaagacaugcuuacugucuggaacaggguguggaucgaggacaacccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7569 - RNA, 9873 nt, Artificial Sequence
  derived and/or modified CDS sequence (wt) from DENV-3__EU482595__SS-prME
acaucgcucugucucaugaugaugcugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuccuugcccauuacguaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacgugugcaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacacagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagguuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaucaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgacauaauuggggucuuagagcaaggaaaaagaauacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucucaaccaacauauggcugaaacuccgagagguguauacccaacugugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaacuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauugggucuaacgcaucugacaggaugggaaugggcguuaccuaccuagcuuuaauugcaacauuuaaaauccagccauucuuggcuuugggauuuuuccuaagaaaacugacauccagagaaaauuuauuauuaggaguugggcuggcuauggcaacaacguuacaacugccagaggacauugaacaaauggcaaacggaaucgcucuggggcucauggcucucaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaacauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuuuaagccuggaacuucaggaucuccuaucauaaacagagagggaaagguagugggacuguauggcaauggagugguuacaaagaaugguggcuacgucagcggaauagcgcaaacgaaugcagaaccagauggaccggcaccagaauuggaagaagagauguucaaaaagcgaaaucuaaccauaauggaucuucauccugggucaggaaagacacggaaauaccuuccagccauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacagugugguuuguccccagcauuaaagccggaaaugacauagcaaacuguuugcgaaaaaacgggaaaaaggucauucaacuuaguaggaagacuuuugacacagaauaucagaaaacuaaacugaaugauugggacuucguggugacgacugacauuucagaaaugggggcuaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgucugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuucuacuccugggacucaugaucuuguugacagguggagcaaugcuuuucuuaauaucagguaaagggauuggaaagacuucaauaggacucaucuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacucacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccugugauauaugauucaaaauuugaaaagcaacugggacagguuaugcuccugguuuugugugcaguucaacuuuuauuaaugagaacaucaugggccuugugugaagcuuuaacucuagcuacaggaccaauaacaacacucugggaaggaucaccugggaaguuuuggaacaccacgauagcuguuuccauggcgaacaucuuuagagggagcuauuuagcaggagcugggcuugcuuuuucuauuaugaaaucuguuggaacagggaaaagaggaacaggcucacagggugaaacuuuaggagaaaaauggaaaaagaaguuaaaucaauuaucccggaaagaguuugaccuuuauaagaaaucuggaaucacugaaguggauagaacagaagccaaagaaggguugaaaagaggagaaauaacacaucaugccguguccagagguagcgcaaaacuucaaugguucguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacaccuuguugugugacauuggagaaucuucaccaagcccaacaguggaggaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggguaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggauacuuguggacagagaacgugagcuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucugggaaaagccuacgcucaaauguggagucucauguauuuucacagaagagaccucagacuagcauccaacgccauauguucagcgguaccaguccacuggguccccacaaguagaacgacauggucuauucaugcucaccaucaguggaugaccacagaagacaugcuuacugucuggaacaggguguggaucgaggacaauccauggauggaagauaaaacuccagucacaaccugggaaaauguuccauaucuagggaagagagaagaccaauggugcggaucacuuauuggucuuacuuccagagcaaccugggcccagaacauacccacagcaauucagcaggugagaagccuuauaggcaaugaagaguuucuggacuacaugccuucaaugaagagauuuaggaaggaggaggagucggagggagccauuugguaa

SEQ ID NO: 7570 - RNA, 9873 nt, Artificial Sequence
  derived and/or modified CDS sequence (wt) from DENV-3__EU482596__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccccugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggggucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7571 - RNA, 9873 nt, Artificial Sequence
  derived and/or modified CDS sequence (wt) from DENV-3__JQ922554__SS-prME
acaucgcucugucucaugaugauguuaccagcaacacuugcuuuccacuuaacuucacgagauggagagccgcgcaugauuguggggaagaaugaaagaggaaaaucccuacuuuuuaagacagccucuggaaucaacaugugcacacucauagccauggauuugggagagaugugugaugacacggucacuuacaaaugcccccacauuaccgaacuggagccugaagacauugacugcuggugcaaccuuacaucgacaugggugacuuauggaacaugcaaucaagcuggagagcauagacgcgauaagagaucaguggcguuagcuccccaugucggcaugggacuggacacacgcacucaaaccuggaugucggcugaaggagcuuggagacaagucgagaagguagagacaugggcccuuaggcacccaggguuuaccauacuagcccuauuucuugcccauuacauaggcacuuccuugacccagaaagugguuauuuuuauacuauuaaugcugguuaccccauccaugacaaugagaugugugggaguaggaaacagagauuuuguggaaggccuaucgggagcuacguggguugacguggugcucgagcacggugggugugugacuaccauggcuaagaacaagcccacgcuggacauagagcuucagaagaccgaggccacccaacuggcgacccuaaggaagcuaugcauugagggaaaaauuaccaacauaacaaccgacucaagaugucccacccaaggggaagcgauuuuaccugaggagcaggaccagaacuacguguguaagcauacauacguggacagaggcuggggaaacgguugugguuuguuuggcaagggaagcuuggugacaugcgcgaaauuucaauguuuagaaucaauagagggaaaaguggugcaacaugagaaccucaaauacaccgucaucaucacagugcacacaggagaccaacaccaggugggaaaugaaacgcagggaguuacggcugagauaacaucccaggcaucaaccgcugaagccauuuuaccugaauauggaacccucgggcuagaaugcucaccacggacagguuuggauuucaaugaaaugauuuuauugacaaugaagaacaaagcauggaugguacauagacaaugguucuuugacuuaccccuaccauggacaucaggagcuacaacaaaaacaccaacuuggaacaggaaagagcuucuugugacauuuaaaaaugcacaugcaaaaaagcaagaagugguuguccuuggaucacaagagggagcaaugcauacagcacugacaggagcuacagagauccaaaccucaggaggcacaaguauuuuugcggggcacuuaaaauguagacucaagauggacaaauuggaacucaaggggaugagcuaugcaaugugcuugaauaccuuuguguugaagaaagaagucuccgaaacgcagcaugggacaauacucauuaagguugaguacaaaggggaagaugcacccugcaagauuccuuucuccacggaggauggacaagggaaagcucacaauggcagacugaucacagccaauccaguggugaccaagaaggaggagccugucaacauugaggcugaaccuccuuuuggggaaaguaauauaguaauuggaauuggagacaaagcccugaaaaucaacugguacaggaagggaagcucgauugggaagauguucgaggccacugccagaggugcaaggcgcauggccaucuugggagacacagccugggacuuuggaucagugggugguguuuugaauucauuagggaaaaugguccaccaaauauuugggagugcuuacacagcccuauuuaguggagucuccuggauaaugaaaauuggaauagguguccucuuaaccuggauaggguugaauucaaaaaacacuuccauggcauuuucaugcauugcgauaggaaucauuacacucuaugugggaguuguggugcaagcugacauggggugugucauaaacuggaaaggcaaagaacucaaauguggaaguggaauuuucgucacuaaugagguccacaccuggacagagcaauacaaauuucaagcagacucccccaaaagacuggcaacagccauugcaggcgcuugggagaauggagugugcggaauuaggucaacaaccagaauggagaaccucuuguggaagcaaauagccaaugaacugaacuacauauuaugggaaaacaacauuaaauuaacgguaguuguaggcgacauaacuggggucuuagagcaaggggaaagaacacuaacaccacaacccauggagcuaaaauauucuuggaaaacauggggaaaggcaaaaauagugacagcugaaacacaaaauuccucuuucauaauagaugggccaagcacaccggaguguccaagugccucaagagcauggaaugugugggagguggaagauuacggguucggaguuuucacaaccaacauauggcugaaacuccgagagguguacacccaacuaugugaccauaggcuaaugucggcagccgucaaggaugagagggccguacacgccgacaugggcuauuggauagaaagccaaaagaauggaaguuggaagcuagaaaaagcaucccucauagaggugaaaaccugcacauggccaaaaucacacacucuuuggagcaauggugugcuagagagugacaugauuaucccaaagagucuagcuggucccauuucgcaacacaaccacaggcccggguaccacacccaaacggcaggacccuggcacuuaggaaaauuggagcuggacuucaacuauugugaaggaacaacaguugucaucucagaaaacugugggacaagaggcccaucauugagaacaacaacagugucagggaaguugauacacgaaugguguugccgcucgugcacacuuccuccccugcgauacaugggagaagacggcugcugguauggcauggaaaucagacccauuaaugagaaagaagagaacaugguaaagucucuagccucagcagggaguggaaagguggacaacuucacaaugggugucuuguguuuggcaauccucuuugaagaggugaugagaggaaaauuuaggaaaaaacacaugauugcagggguucucuucacguuugugcuccuccucucagggcaaauaacauggagagacauggcgcacacacucauaaugauuggguccaacgccucugacagaauggggaugggcgucacuuaccuagcucuaauugcaacauuuaaaauucagccauucuuggcuuugggauucuuccugaggaaacugacaucuagagaaaauuuauugcugggaguuggguuggccauggcagcaacguuacgacugccagaggacauugaacaaauggcgaauggaauugcuuuggggcucauggcucuuaaacugauaacacaauuugaaacauaccaacuauggacggcauuaguuucccuaacguguucaaauacaauuuucacguugacuguugccuggagaacagccacucugauuuuagccggaauuucgcuuuugccagugugccagucuucgagcaugaggaaaacagauuggcucccaaugacuguggcagcuaugggaguuccaccccuaccacuuuuuauuuucagucugaaagauacacucaaaaggagaagcuggccacugaaugagggggugauggcaguuggacuugugagcauucuagcuaguucucuccuuaggaaugaugugcccauggcuggaccauuaguggcugggggcuugcugauagcgugcuacgucauaacuggcacgucagcagaccucacuguagaaaaagcagcagauguaacaugggaggaagaggccgagcaaacaggagugucccacaauuuaaugaucacaguugaugaugauggaacaaugagaauaaaagaugacgagacugagaacaucuuaacagugcuuuuaaaaacagcacuacuaauaguaucaggcaucuuuccauacuccauacccgcaacacuguuggucuggcauacuuggcaaaagcaaacccaaagauccggcguccuaugggacguacccagccccccagagacacagaaagcggaacuggaagaaggggucuauaggaucaaacagcaaggaauuuuugggaaaacccaaguggggguuggaguacagaaagaaggaguuuuccacaccauguggcacgucacaagaggggcaguguugacacacaaugggaaaagacuggaaccaaacugggcuagcgugaaaaaagaucugauuucauacggaggaggauggagauugagugcacaaugggcaaaaggaggggagacgcagguuauugccguagagccugggaagaacccaaagaacuuucaaaccaugccaggcauuuuucagacaacaacaggggaaauaggagcaauugcacuggauuucaagccuggaacuucaggaucucccaucauaaacagagagggaaagguagugggacuguauggcaauggagugguuacaaagaauggaggcuaugucaguggaauagcgcaaacaaaugcagaacuagauggaccgacaccagaguuggaagaagagauguucaaaaagcgaaaucuaaccauaauggaucuucauccugggucaggaaagacgcggaaauaucuuccagcuauuguuagagaggcaaucaagagacgcuuaaggacucuaauuuuggcaccaacaaggguaguugcagcugagauggaagaagcauugaaagggcucccaauaagguaucaaacaacugcaacaaaaucugaacacacaggaagagagauuguugaucuaaugugucacgcaacguucacaaugcgcuugcugucaccaguccgggguucaaacuacaacuugauaauaauggaugaggcucauuucacagacccagccaguauagcggcuauaggguacauaucaacucguguaggaaugggagaggcagccgcaauuuucaugacagcaacacccccuggaacaguugaugccuuuccucagagcaucccuccaauucaagaugaagagagagacauaccggaacgcucauggaauucaggcaaugaauggauuacugacuuuguugggaagacagugugguuugucccuagcaucaaagccggaaaugacauagcaaacugcuugcggaaaaauggaaaaaaggucauucaacucagcaggaagaccuuugacacagaauaucaaaagaccaaacugaaugauugggacuuuguggugacaacagacauuucagaaaugggagccaauuucaaagcagauagagugaucuaccuuagaagaugucucaagccggugauuuugacaaauggacccgagcgggugauccuggcuggaccaaugccagucaccguagcgagcgcugcgcaaaggagagggagaguuggcaggaacccacaaaaagaaaaugaccaguacauauucaugggccagccucucaacaaugaugaagaccaugcucacuggacagaagcaaaaaugcugcuggacaacaucaacacaccagaagggauuauaccagcucucuuugaaccagaaagggagaagucagccgccauagacggcgaauaccgccugaagggugaguccaggaagacuuucguggaacucaugaggaggggugaccucccaguuuggcuagcccauaaaguagcaucagaagggaucaaauauacagauagaaaauggugcuuugauggagaacguaauaaucaaauuuuagaggagaauauggauguggaaaucuggacaaaggaaggagaaaagaaaaacuggagaccuagguggcuugaugcccgcacuuauucagauccuuuagcacucaaggaauucaaggauuuugcagcuggcagaaagucaaucgcccuugaucuugugacagaaauaggaagagugccuucacacuuagcccacacaguacgaaacgcccuggacaauuuggugaugcugcacacgucagaacauggcgguagggccuacaggcaugcaguggaggaacuaccagaaacgauggaaacacucuuacuccugggacugaugaucuuguuaacagguggagcaaugcucuucuugauaucagguaaagggauuggaaagacuucaauaggacucauuuguguaauugcuuccagcggcauguuauggauggcugaugucccacuccaauggaucgcgucggcuauaguccuggaguuuuuuaugaugguguugcucauaccagaaccagaaaagcagagaacuccccaagacaaccaacucgcauaugucgugauaggcauacuuacauuggcugcaauaguagcggccaaugaaaugggacuguuggaaacuacaaagagagauuuaggaaugucuaaagaaccagguguuguuucuccaaccagcuauuuggacguggacuugcacccagcaucagccuggacauuguacgccguggccacaccaguaauaacaccaauguugagacacaccauagagaauuccacagcaaaugugucccuggcagccauagcuaaccaggcagugguccugauggguuuagacaaaggauggccgauaucgaaaauggacuugggcguaccacuauuggcacuggguugcuauucacaagugaacccacuaacucuugcagcggcaguacuuuugcuagucacacauuaugcaauuauagguccaggauugcaggcaaaagccacucgugaagcucagaaaaggacagcugcuggaauaaugaagaauccaacgguggauggaauaaugacaauagaccuagauccuguaauauaugauucaaaauuugaaaagcaacuaggacagguuaugcuccugguucugugugcaguucaacuuuuguuaaugagaacaucauggcccuugugugaaguccuagcccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaaccuuaggagaaaaguggaaaaagaaauuaaaucaguuaucccggaaagaguuugaccuuuacaagaaauccggaaucaccgaaguggauagaacagaagccaaagaaggguuaaaaagaggagaaauaacacaccaugccguguccagaggcagcgcaaaacuucaaugguucguggagagaaacauggucuuucccgaaggaagagucauagacuuaggcuguggaagaggaggcuggucauauuacugugcaggacugaaaaaaguuacagaagugcgaggauacacaaaaggcggcccaggacacgaagaaccaguaccuaugucuacauacggauggaacauagucaaguuaaugaguggaaaggauguuuuuuaucugccaccugaaaagugugauacccuauugugugacauuggagaaucuucaccaagcccaacaguggaagaaagcagaaccauaagagucuugaagaugguugaaccauggguaaaaaacaaccaguuuugcauuaagguuuugaacccuuacaugccaucugugauugagcacuuggaaaacuuacaaaggaaacauggaggaauccuugugagaaauccacucucacgaaacuccacgcacgaaauguauuggauauccaaugguacaggcaacaucgucucuucagucaacaugguauccagauugcuacugaacagauucacaaugacacacaggagacccaccauagagaaagauguggauuuaggagcaggaacccgacaugucaaugcggaaccagaaacacccaacauggaugucauuggggaaagaauaaaaaggaucaaagaggagcauaguucaacauggcacuaugaugaugaaaauccuuacaaaacgugggcuuaccauggauccuaugaaguaaaagccacaggcucagccuccuccaugauaaauggagucgugaaacuccucacaaaaccaugggauguggugcccauggugacacagauggcaaugacagauacaacuccauuuggccagcaaagaguuuuuaaagagaaaguggacaccaggacaccuaggcccaugccaggaacaagaaagguuauggagaucacagcggaguggcuuuggaggacccugggaaggaacaaaagacccagauuaugcacaagggaggaguucacaaagaaggucagaaccaacgcagcuaugggcgcugucuucacagaagagaaccaaugggacagugcgagagcugcuguugaggacgaagaauuuuggaaacuuguggacagagaacgugaacuccacaaacugggcaaguguggaagcugcguuuacaacaugaugggcaagagagagaaaaaacuuggagaguuugguaaagcaaaagacaguagggcuauaugguacaugugguugggagccagguaccuugaguucgaggcgcucggauuccucaaugaagaccacugguucucgcgugaaaacucuuacaguggaguagaaggagaaggacugcacaagcugggauacaucuugagagauauuuccaagauacccggaggagccauguaugcugaugacacagccgguugggacacaagaauaacagaagaugacuugcacaaugaggaaaaaaucacacagcagauggcccgugaacacaggcagcuagcgaacgccauauucaagcucacauaccaaaacaaaguggucaaaguccaacgaccaacuccaaagggcacgguaauggacaucauaucuaggaaagaccaaagaggcaguggacaggugggaacuuauggucugaacacauucaccaacauggaagcccagcuaaucagacaaauggaaggagaaggcguguugucaaaggcagaccucgagaacccccauccgcuagagaagaaaauuacacaaugguuggaaacuaaaggaguggagagguuaaaaagaauggccaucagcggggaugauugcguagugaaaccaaucgacgacagauucgccaaugcccugcuugcccugaacgauaugggaaagguuaggaaggacauaccucaauggcagccaucaaagggauggcaugauuggcaacaggucccuuucugcucccaccacuuucaugaauugaucaugaaagauggaagaaaguugguaguucccugcagaccccaggacgaacuauuagggaaggcgagaaucucucaaggagcaggauggagccuuagagaaacugcaugucuagggaaagccuacgcucaaauguggacucucauguauuuucacagaagagaucuuagacuagcauccaacgccauauguucagcaguaccaguccauuggguccccacgagcagaacgacauggucuauucaugcucaccaucaguggaugacuacagaagacaugcuuacugucuggaacaggguguggauagaggacaauccauggauggaagacaaaacuccagucacaacgugggaagauguuccauaucuagggaagagagaagaccaauggugcggaucacucauaggucucacuuccagagcaaccugggcccagaacauacucacagcaauccaacaggugagaagccucauaggcaaugaagaguuucuggacuacaugccuucgaugaagagauucaggaaggaggaggagucagagggagccauuugguaa

SEQ ID NO: 7572 - RNA, 9873 nt, Artificial Sequence
  derived and/or modified CDS sequence (wt) from DENV-3__EU529683__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggauacacgcacccaaacuuggaugucggcugaaggagcuuggaggcaagucgagaagguagagacaugggcccucaggcacccaggguucaccauacuagcccuauuucuugcccauuacauaggcacuuccuugacccagaaggugguuauuuuuauacugcuaaugcuggucaccccauccaugacaaugagaugugugggaguaggaaacagagauuuuguggaaggacuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccaaaacuacguguguaagcauacauacguagacagaggcugggggaacggaugugguuuguuugguaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguucuugggucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacuuaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucaucacacucuaucugggagcuguggugcaagcugacacgggguguguuauaaacuggaaaggcaaagaacucaaguguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguuguugugggcgauauaauuggggucuuagagcaagggaaaagaacacuaacaccacaacccauggagcuaaaauacucauggaaaacguggggaaaggcaagaauagugacagcugaaacacaaaauucuucuuucauaauagauggaccaaacacaccggaguguccaaauaccucaagagcauggaaugugugggagguggaagauuacggguucggagucuucacaaccaacauauggcugaaacuccgagagguguauacccaacuaugugaccauagguuaaugucggcagccgucaaggaugaaagggccguacaugccgacaugggcuauuggauagaaagucaaaagaauggaaguuggaagcuagaaaaagcaucccucauagaggugaaaaccugcacauggccaaaaucacauacccuuuggaguaaugguguguuagagagugacaugaucauuccaaaaagucuagcugguccuaucucgcaacacaacuacaggcccggguaccacacccagacggcgggaccuuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagaaaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaaugcaacugacaggaugggaaugggcgucaccuaccuagcuuuaauugcaacauuuaaaauccagccauuuuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucucaaacugauaacacaauuugaaacauaccaacuauggacagcauuaaucuccuuaacguguucaaauacaauuuuuacguugacuguugccuggagaacagccacccugauuuuggcuggaguuucacuuuuaccagugugccagucuucgaguaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagcccggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccaacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauauucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaauugccugcggaaaaacgggaaaaaggucauucaacuuaguaggaagacuuuugacacagaauaucagaaaaccaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcagcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcucgcaccuauucagaucccuuagcacucaaggaauucaaggacuuugcggcuggcaggaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacacuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguugagacauaccauagagaauuccacagcaaauguguccuuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugccauuauagguccaggauugcaggcaaaagccacccgugaagcucagaaaaggacagcugcuggaauaaugaagaauccaacaguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacccuagcuacaggaccaauaacaacacucugggaaggaucaccugggaaguuuuggaacaccacgauagcuguuuccauggcgaacauuuuuagagggagcuauuuagcaggagcugggcuugcuuucucuauuaugaaaucaguuggaacagggaaaagaggaacaggcucacagggugaaacuuugggagaaaaauggaaaaagaaguuaaaucaauuaucccggaaagaguuugaccuuuacaagaaaucuggaaucacugagguggauagaacagaagccaaagaaggguugaaaagaggagaaauaacacaucaugccguguccagagguagugcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccagcugugauugagcaccuagaaagacuacaaaggaaacauggaggaaugcuugugagaaauccacuuucacgaaacuccacgcacgaaauguacuggauauccaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuacgaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggagaucacagcggaguggcucuggagaacccugggaaggaauaaaaaacccagguuaugcacaagggaagaguuuacaaaaaaggucagaacuaacgcagccaugggagcuguuuucacagaggagaaccaaugggacagcgcgaaagcugcuguugaggaugaggauuuuuggaaacuuguggacagagaacgugaacuccacaaacugggcaaguguggaagcuguguuuacaacaugauggguaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggauaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauaagcggggaugacugcguagugaaaccaaucgaugacagguucgcuaaugcccugcucgcucugaacgacaugggaaagguccggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucacgcucaccaucaguggaugaccacagaagacaugcuuacugucuggaacagaguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7573 - RNA, 9873 nt, Artificial Sequence
  derived and/or modified CDS sequence (wt) from DENV-3__EU529684__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaaaguuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauuaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaaaaacuuucaaaccaugccaggcacuuuucagacuacaacaggggaaauaggagcaauugcacuggauuucaagccuggaacuucaggaucuccuaucauaaacagagagggaaagauagugggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagaggcguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaccgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacuaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaauauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaugagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguucacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauuuaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggagaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7574 - RNA, 9873 nt, Artificial Sequence
  derived and/or modified CDS sequence (wt) from DENV-3__FJ182015__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagccuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaggaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuucuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggcgcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgcuauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7575 - RNA, 9873 nt, Artificial Sequence
  derived and/or modified CDS sequence (wt) from DENV-3__EU569688__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaagcggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagauagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuucguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugagggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaagacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagcauggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcacuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaggugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccagaacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7576 - RNA, 9873 nt, Artificial Sequence
  derived and/or modified CDS sequence (wt) from DENV-3__EU529686__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaaugcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauagugauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggccuggauaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaacuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacgguugaugaugauggaacaaugagaauaaaagaugaugagacugagaauaucuuaacagugcuuuugaaaacagcuuuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaauaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguuacuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguugaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggauugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugagaauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacucucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7577 - RNA, 9873 nt, Artificial Sequence
  derived and/or modified CDS sequence (wt) from DENV-3__EU529687__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucgguaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguggacagagguugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcaucgcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcaaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucgugucggaaugggagaagcagccgcaauuuucaugacagcaacgcccccuggaacagcugaugccuuuccucagagcaacgcuccaauucaagaugaagaaaaggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggauaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcccagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagagucuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccagagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7578 - RNA, 9873 nt, Artificial Sequence
  derived and/or modified CDS sequence (wt) from DENV-3__KF955449__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuguacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcugugguacaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacacacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauccuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcguuugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuacuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacucuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaaugcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaucucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7579 - RNA, 9873 nt, Artificial Sequence
  derived and/or modified CDS sequence (wt) from DENV-3__FJ373303__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccagaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuucguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaaugucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagaugugacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauagugucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuacaggaucaaacagcaaggaauuuuugggaaaacccaaguagggguuggaguacagaaagaaggagucuuucacaccauguggcacguuacaagaggggcagugcugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcugccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcgaaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcccauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuucuagcggcauguuguggauggcugaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccucugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggcccugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaagucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacguagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcacaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7580 - RNA, 9873 nt, Artificial Sequence
  derived and/or modified CDS sequence (wt) from DENV-3__KF955451__SS-prME
acaucgcucugucuuaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaagugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaacacuuuuguguugaagaaagaagucucagaaacgcagcaugggacaauacucaucaaggucgaguacaaaggggaagauguaccuugcaagauuccuuucuccacagaggauggacaagggaaagcucacaauggcagacugaucacagccaacccaguggugacuaagaaggaggagccugucaauauugaggcugaaccuccuuuuggggaaaguaauauaguaauuggaguuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggaguuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcaacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagaugguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggagucgggcuggcuauggcaacaacguuacaacugccagaggacguugaacaaauggcaaauggaaucgcucuggggcucauggcucuuaaacugauaacacaauuugaaacauaccaauuauggacagcauuaaucuccuuaacguguucaaauacaauuuuuacgcugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuaugucauaacuggcacgucagcagaccucaccguagaaaaagcagcagauguaacaugggaggaagaggcugagcaaacaggagugucccacaauuuaaugaucacaguugaugaugauggaacaaugagaauaaaagaugaugagacugaaaacaucuuaacagugcuuuugaaaacagcauuacuaauaguaucaggaaucuuuccauacuccauacccgcaacauuguuggucuggcauacuuggcaaaagcaaacccaaagauccggcguuuuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauacaaugggaaaagacuggaaccaaacugggcuagcgugaaaaaagaucugauuucauacggaggaggauggagauugaacgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggauacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaagcgcucuggacaaucuggugaugcugcauacgucagaacauggcgguaaggccuacaggcaugcgguggaggaacuaccagagacaauggaaacacuccuacucuugggacucaugaucuugcugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacucacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugaugggcuuggacaaaggauggccaauaucaaaaauggacuuaggaguaccccugcuggcacuggguugcuauucacaagugaacccauugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacucuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaggaaguuaaaucaauuaucccggaaagaguuugaccuuuacaagaaaucuggaaucacugaaguggauagaacagaagccaaagaaggguugaaaagaggagaaauaacacaucaugccguauccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacaugucaacgcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaagccaugggauguggugcccauggugacacagauggcaaugacagauacaacuccauuuggccagcagagagucuuuaaagagaaaguggacaccaggacacccaggcccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuucuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccccaucugucagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7581 - RNA, 9873 nt, Artificial Sequence
  derived and/or modified CDS sequence (wt) from DENV-3__KF955453__SS-prME
acaucgcucugucucaugaugauauugccagcaacacuugcuuuccacuugacuucacgagauggagagccgcgcaugauuguggggaagaaugaaagagggaaaucccuacucuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaauauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuccaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaccuugccugaauauggaacccuugggcuagaaugcucaccacggacagguuuggacuuuaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcagggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuaucgggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagccaugggaguuccaccucuaccacuuuuuauuuuuaacuuaaaagacacacuuaaaaggagaagcuggccacugaaugaaggggugauggcuguugggcuugugagcauucuggcuaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaagugcagguuauugccguagagccugggaagaacccaaagaacuuucaaaccaugccaggcacuuuucagaccacaacaggggaaauaggagcaauugcacuggauuucaagccuggaacuucaggaucuccuaucauaaacagagagggaaagauagugggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacauacaggaagagagaucguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcuggaaaaacggugugguuuguccccagcauuaaagccggaaaugacauagcaaacugccugcggaaaaacggaaaaaaggucauucaacucaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgagugauccuggcuggaccaaugccagucaccgcggcgagugcugcgcaaaggagagggagaguuggcaggaacccacaaaaagaaaaugaccaguacauauucacgggccagccucuuaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucucguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacacuguacgcuguggccacuacaguaauaacaccaauguuaagacauaccauagagaauucuacagcaaaugugucccuggcagcuauagccaaccaggcagugguccugauggguuuggacaaaggguggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaagaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaaccagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggugccauuugguaa

SEQ ID NO: 7582 - RNA, 9873 nt, Artificial Sequence
  derived and/or modified CDS sequence (wt) from DENV-3__FJ373304__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagccacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacucuugggcuagaaugcucaccacggacagguuuggacuucaaugaaaugaucuuguuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcacaccgcauugacaggagccacagaaauccaaaacucaggaggcacaagcauuuuugcggggcacuuaaaauguagacuuaagauggacaaauuagaacucaagggaaugagcuaugcaaugugcacgaacaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaguggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauacuuggacagagcaauacaaauuccaggcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauugcuaggaguugggcuggcuauggcaacaacguuacaacugccagaggacauugaacaaauggcaaauggaaucgcucuggggcucauggcucucaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuucagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacaaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaccuaaugugccacgcaacguucacaaugcgucugcugucaccaguuaggguuccaaauuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaggaaagggacauaccagaacgcucauggaauucaggcaaugaauggauaaccgacuucgcugggaaaacggugugguuuguucccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucacagcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacacuuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaauccuggaguuuuuuaugaugguguugcuuauaccagaaccagaaaagcagagaaccccccaagacaaccaacucgcauaugucgugauaggcauacuuacauuggcggcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucuccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaagcuucaaugguuuguggagagaaacauggucauucccgaaggaagaguuauagacuugggcuguggaagaggagguuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagagacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccaucagcggggaugauugcguagugaaaccaaucgaugacagguucgcuaaugcccugcucgcccugaacgauaugggaaagguucggaaggacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucugggaaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7583 - RNA, 9873 nt, Artificial Sequence
  derived and/or modified CDS sequence (wt) from DENV-3__EU854291__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacgaucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuucguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugggguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauugggguuuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccacaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuagggaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccgucagugagaaagaagagaacaugguaaagucuuuagucucagcgggaaguggagagguggauaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacgugcucaaauacaauuuucacguugacuguugccuggagaacagccacccugauuuuggccggaguuucgcuuuuaccagugugccagucuucgaguaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauaccugcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagugcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaagguuauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagucauccugacagauggaucagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucauuggacggaagcaaaaaugcugcuggacaacauuaacacaccagaagggaucauaccagcucucuuugagccagaaagggagaagucagccgccauagacggugaguaucgccugaaaggugaguccaggaagaccuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcacacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaacaauagcagccaaugaaaugggauuguuggaaacuacaaagagagauuuaggaaugucuaaggagccagguguuguuucuccaaccagcuauuuagauguggacuugcacccagcaucagcuuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcacuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuggauccuguaauauaugauucaaaauuugaaaagcaacugggacagguuaugcuccugguuuugugugcaguucagcuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacggggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaagggcgguccaggacacgaagaaccaguaccuauguccacauauggguggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaauauugucgcuucagucaacaugguaucuagacugcuacugaacagguucacgaugacacacagaagaccuaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggauaccagaacacccaggcccaugccaggaacaagaaggguuauggggaucacagcggaguggcucuggagaacccugggaaggaauaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagccauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcuggcugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcagcggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagagaccgcaugucuggggaaagccuacgcucaaauguggagucucauguacuuucacagaagagaccucagacuagcauccaacgccauauguucagcaguaccaguccacuggguccccacaaguagaacgacauggucuauucaugcucaccaucaguggaugacaacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7584 - RNA, 9873 nt, Artificial Sequence
  derived and/or modified CDS sequence (wt) from DENV-3__KF955454__SS-prME
acaucgcuuugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacaugcaaucaagccggagagcauagacgcgacaagagaucaguggcguuagcuccccaugucggcaugggauuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggccaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagaaggaaaaguggugcaauaugagaaccucaaauacaccgucaucaucacagugcacacaggagaccaacaccaggugggaaaugaaacacagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucucgugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggggucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuauauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagggugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacauuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggccauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacaauuuuuacguugacuguugccuggagaacagcuacccugauuuuggccggaguuucgcuuuuaccagugugccagucuucgagcaugaggaaaacagacuggcuuccaaugacgguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuugacagugcuuuugaaaacagcauuacuaauaguaucaggaaucuuuccauacuccauacccgcaacauuguuggucuggcauacuuggcaaaagcaaacucaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguugagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguagcagcugagauggaggaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcgaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuuccuggaacucaugaggaggggugaccuuccagucugguuagccuauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcacacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccagcucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuugggagaaaaauggaaaaagaaauuaaaucaauuaucccggaaagaguuugaccuuuacaagaaaucuggaaucacugaaguggauagagcagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugauauuggagaaucuucaccaagcccaacaguggaagaaagcagaacuauaagaguuuugaagaugguugaaccauggcuaaagaacaaccaauuuuguauuaaaguacugaacccuuacaugccaacugugauugagcaccuagaaagacuacaaaggaaacauggaggaaugcuugugagaaauccacuuucacgaaacuccacgcaugaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaucaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaaaauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucauccgccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagggaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaacguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggaaggagccauuugguaa

SEQ ID NO: 7585 - RNA, 9873 nt, Artificial Sequence
  derived and/or modified CDS sequence (wt) from DENV-3__EU854292__SS-prME
acaucgcucugucucaugaugauauugccagcagcacuugcuuuccacuugacuucacgagauggagagccgcgcaugauuguggguaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguggagacaugggcccuuaggcacccaggguucaccauacuagcccuauuucuugcccauuacauaggcacauccuugacccagaaggugguuauuuuuauacuacuaaugcuggucaccccauccaugacgaugagaugugugggaauaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcggcuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaacaugagaaccucaaauacaccgucaucaucacagugcacacaggagaucaacaccaggugggaaaugaaacgcagggagucacggcugagauaacaccucaggcaucaaccacugaagccaucuugccugaauauggaacucuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaagaaacaagaaguaguuguccuuggaucgcaagagggagcaaugcacaccgcauugacaggagccacagaaauccaaaacucaggaggcacaaguauuuuugcggggcacuuaaaaugcaggcuuaagauggacaaauuggaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaagcaauauagugauuggaauuggagacaacgccuugaaaaucaacugguauaagaagggaagcucuauugggaagauguucgaggccacugccagaggugcaaggcgcauggccaucuugggagacacagcuugggacuuuggaucaguggguggcguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagaacaauacaaguuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccgcaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauugaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccucccuugcgauacaugggagaagacggaugcugguauggcauggaaaucagacccaucagugagaaagaagagaacaugguaaagucuuuagucucagcgggaaguggaaagguggacaacuucacaaugggugucuugugcuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccucagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaacacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuugcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggaaucuuuccauacuccauacccgcaacauugcuggucuggcauacuuggcaaaagcaaacccaaagguccggcguucuaugggacguacccagccccccagagacacagaaagcagaacuggaagaaggggucuauaggaucaaacagcaaggaauuuuugggaaaacccaaguggggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaacgcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacaucucagaaaugggggccaacuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacauaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgcuauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggauugcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauugcuggaaacuacaaagagagauuuaggaaugucuaaggagccagguguugucucuccaacuagcuauuuagauguggacuugcacccagcaucagccuggacauuguacgccguggccacuacaguaauaacaccaauguuaagacauaccauagagaauucuacagcaaauguaucucuggcagcuauagccaaccaggcagugguccugauggguuuggacaaaggauggccaauaucaaaaauggaccuaggaguaccccuacuggcauuggguugcuauucacaagugaacccacuaacucuaacagcggcaguacucuugcugaucacacauuaugcuauuauagguccaggauugcaagcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguucugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuuccauuaugaaaucaguaggaacaggaaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgccucagucaacaugguaucuagacugcuacugaacagguucacgaugacacacagaagacccaccauugagaaagauguggauuuaggagcaggaacucgacauguuaaugcggaaccagaaacacccaauauggaugucauuggggaaagaauaaaaaggaucaaggaggagcauaauucaacauggcacuaugaugacgaaaaccccuacaaaacgugggcuuaucauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaaccuagguuaugcacaagggaagaguuuacaaagaaggucaggacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguuaggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaaucacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccucaaagaaaccgcaugucuggggaaagccuacgcucaaauguggagucucauguauuuucacagaagagaccucagacuagcauccaaugccauauguucagcaguaccaguccacuggguccccacaaguagaacgacauggucuauucaugcucaccaucaguggaugaccacagaggacaugcuuacugucuggaacaggguguggaucgaggacaauccauggauggaagacaaaacuccaguuacaaccugggaaaauguuccauaucuagggaagagagaagaccaauggugcggaucacuuauuggucucacuuccagagcaaccugggcccagaacauaccuacagcaauucaacaggugagaagccuuauaggcaaugaagaguuucuggacuacaugccuucaaugaagagauuuaggaaggaggaggagucggagggagccauuugguaa

SEQ ID NO: 7586 - RNA, 9873 nt, Artificial Sequence
  derived and/or modified CDS sequence (wt) from DENV-3__FJ639746__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcacacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaucuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgagaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugguugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucgucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccaaucacaaccugggaaaauguuccauaucuagggaagagagaagaccaauggugcggaucacucauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7587 - RNA, 9873 nt, Artificial Sequence
  derived and/or modified CDS sequence (wt) from DENV-3__FJ639750__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaagguugaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaauaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccuggaucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaagggaguggagagguuaaaaagaauggccauuagcggggaugauugcguagugaaaccaaucgaugacagguucgcuaaugcccugcucgcucugaacgauaugggaaagguucggaaagacauaccucaauggcagccgucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7588 - RNA, 9873 nt, Artificial Sequence
  derived and/or modified CDS sequence (wt) from DENV-3__FJ639754__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaguacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaagguugaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggagaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaauaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuucuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccuggaucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaacuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaauccucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauuggguaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaagggaguggagagguuaaaaagaauggccauuagcggggaugauugcguagugaaaccaaucgaugacagguucgcuaaugcccugcucgcucugaacgauaugggaaagguucggaaagacauaccucaauggcagccgucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7589 - RNA, 9873 nt, Artificial Sequence
  derived and/or modified CDS sequence (wt) from DENV-3__FJ639757__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuauuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguggacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacagcgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucacuaacgagguucauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcgggggucuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccuuuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacguuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaaggacucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaaaacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugcccacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuuacugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagagauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7590 - RNA, 9873 nt, Artificial Sequence
  derived and/or modified CDS sequence (wt) from DENV-3__FJ639758__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugucuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguucuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggauaaauuagaacucaaggggaugagcuaugcaaugugcacgaauaccuuuguguugaagaaagaagucucagaaacacagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauguaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaacggaaguuggaagcuagaaaaagcaucccucauagagguaaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuacugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaauugcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuuuaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguauugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgagaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaacuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccgguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugguugagcaccuagaaagacuacaaaggaaacauggaggaaugcuugugagaaauccacuuucacgaaacuccacgcaugaaauguacuggauaucuaauggcacaggcaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcagguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaauauggaagcccaguuaaucagacaaauggaaggagaaggugugcugucaaaggcagaccucgagaacccucgucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacucauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7591 - RNA, 9873 nt, Artificial Sequence
  derived and/or modified CDS sequence (wt) from DENV-3__FJ639759__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacaugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaaaauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguucucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggauuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaauggaaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagauagugggacuguauggcaauggagugguuacaaagaaugguggcuaugucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaucagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaacucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacaggugggaacuuauggucugaauacauucaccaacauggaagcccaguuaaucagacaaauggaaggagaaggugugcugucaaaggcagaccucgagaacccucauuugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7592 - RNA, 9873 nt, Artificial Sequence
  derived and/or modified CDS sequence (wt) from DENV-3__FJ639761__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacaugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccucaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccugcaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacuuaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggggucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagaaccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaucaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggaguaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaaccacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcuuacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcuggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucggccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7593 - RNA, 9873 nt, Artificial Sequence
  derived and/or modified CDS sequence (wt) from DENV-3__FJ639762__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauaucaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcacaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaagaucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggauuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaaacaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagauagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaagacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaauccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacaugaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7594 - RNA, 9873 nt, Artificial Sequence
  derived and/or modified CDS sequence (wt) from DENV-3__FJ639763__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggcgguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaaugcagacuuaagauggacaaauuagaacucaaggggaugagcuaugcaaugugcacgaauaccuucguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgccugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagaccaaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacaacaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggacguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcccauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaagucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaagcauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuacauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguccaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaacggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7595 - RNA, 9873 nt, Artificial Sequence
  derived and/or modified CDS sequence (wt) from DENV-3__FJ639765__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacugaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcuuauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaauccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguugucucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucgaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacuuuagcuacaggaccaauaacaacacucugggaaggaucaccugggaaguuuuggaacaccacgauagcuguuuccauggcgaacauuuuuagagggagcuauuuagcaggagcugggcuugccuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggacgaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguuuucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuaguggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7596 - RNA, 9873 nt, Artificial Sequence
  derived and/or modified CDS sequence (wt) from DENV-3__FJ639766__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucauuaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggaaccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcguauggccaucuugggagacacagcuugggacuuuggaucagugggugguguucugaacucauuaggcaaaauggugcaucaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacauggggugugucauaaacuggaaaggcaaagaacucaaauguggaaguggaauuuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaaucgcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuaacuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcaggucauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaaccugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguugguaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugaugggcuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacggggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccuugagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguccccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7597 - RNA, 9873 nt, Artificial Sequence
  derived and/or modified CDS sequence (wt) from DENV-3__FJ639767__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaaugcggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaagggaaaagaacacuaacaccacaacccauggagcuaaaauacucauggaaaacguggggaaaggcaaaaauagugacagcugaaacacaaaacucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuuggaaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcacuacuaauaguaucaggaaucuuuccauacuccauacccgcaacauuguuggucuggcacacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccggcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucagguaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaucagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccgauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggauguuauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggucacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguuaggagccagguaccuugaguucgaagcccuuggauucuuaaaugaagaccacugguucucgcgugagaacucuuacaguggaguggaaggagaaggacugcauaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccucauaggcaaugaagaguuucuggacuacaugccuucaaugaagagauuuaggaaggaggaggagucggagggagccauuugguaa

SEQ ID NO: 7598 - RNA, 9873 nt, Artificial Sequence
  derived and/or modified CDS sequence (wt) from DENV-3__FJ639768__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccagguaggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcacacugcauugacaggagccacagaaauccaaaacucaggagguacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauaggaguucucuugacuuggauaggguugaauucaaaaaacacauccaugucauuuucaugcauugcgauaggaaucaucacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacucaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugaacgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaauaccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauauagcaggagcugggcuugcuuuuucuauuaugaaaucaguuggaacaggaaaaagaggaacaggcucacagggugaaacuuuaggagaaaaauggaaaaagaaguuaaaucaauuaucucggaaagaguuugaccuuuacaagaaaucuggaaucacugaaguggauagaacagaggccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7599 - RNA, 9873 nt, Artificial Sequence
  derived and/or modified CDS sequence (wt) from DENV-3__FJ639769__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagccuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagccacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcuuauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucgaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuuguguguaguucaacuuuuguuaaugagaacaucaugggccuugugugaagcuuuaacuuuagcuacaggaccaauaacaacacucugggaaggaucaccugggaaguuuuggaacaccacgauagcuguuuccauggcgaacauuuuuagagggagcuauuuagcaggagcugggcuugccuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggacgaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguuuucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7600 - RNA, 9873 nt, Artificial Sequence
  derived and/or modified CDS sequence (wt) from DENV-3__FJ882577__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauaucaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcacaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagacuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggauuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaaacaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagauagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaagacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaauccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugcgcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaagaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcagcagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7601 - RNA, 9873 nt, Artificial Sequence
  derived and/or modified CDS sequence (wt) from DENV-3__FJ850096__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaacauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggacuucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggaguguguggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggagugcccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucacugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccgauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggacuuaggagcaggaacucgacauguuaaugcggaaccagaaacacccaacauggauguuauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggucacacagauggcaaugacagauacaacuccauuuggccaacagagagucuuuaaagagaaaguggacaccaggacacccagguccaugccaggaacaagaagggucauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcauaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguucacuggguccccacaaguagaacgacauggucuauucacgcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccucauaggcaaugaagaguuucuggacuacaugccuucaaugaagagauuuaggaaggaggaggagucggagggggccauuugguaa

SEQ ID NO: 7602 - RNA, 9873 nt, Artificial Sequence
  derived and/or modified CDS sequence (wt) from DENV-3__FJ882578__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacgggggaugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaaguuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauucaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaauacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacaucuagagaaaauuuauugcuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaccugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaaccaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuucuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcaaccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7603 - RNA, 9873 nt, Artificial Sequence
  derived and/or modified CDS sequence (wt) from DENV-3__FJ639770__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacaucgacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccuuuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagccuuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauguaauuggggucuuagagcaaggaaaaagaacacuaacacuacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacacacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaauugcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccacuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauccaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcucauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgagaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccagugccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugguugagcaccuagaaagacuacaaaggaaacauggaggaaugcuugugagaaauccacuuucacgaaacuccacgcacgaaauguacuggauaucuaauggcacaggcaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucgucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacucauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7604 - RNA, 9873 nt, Artificial Sequence
  derived and/or modified CDS sequence (wt) from DENV-3__FJ639771__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcggucuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacacagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauuuugcgggaaaacaauaucaaauuaacgguaguugugggcgauguaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaggauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaacggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuugugcuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguaugguaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauaguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgccccccggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacuuaugaggaggggugaccuuccagucugguuagcccauaaaguagcaucagaagggaucaaauauacagauagaaaauggugcuuugauggacaacguaauaaucaaauuuuggaagagaacauggauguggaaaucuggacaaaggaaggagaaaagaaaaaauugagaccuagguggcuugaugcccgcaccuauucagaucccuuagcacucaaggaauucaaagacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcgggcuguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgagaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugguugagcaccuagaaagacuacaaaggaaacauggaggaaugcuugugagaaauccacuuucacgaaacuccacgcacgaaauguacuggauaucuaauggcacaggcaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccaugguucuuaugaagucaaagccacaggcucagccuccuccaugauaaauggagucgugaaacuccucaccaaaccaugggauguggugcccauggugacacagauggcaaugacagauacaacuccauuuggccagcagagaguauuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucgucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacucauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguag

SEQ ID NO: 7605 - RNA, 9873 nt, Artificial Sequence
  derived and/or modified CDS sequence (wt) from DENV-3__FJ639772__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacaugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaaaauggacaaauuagaacucaaggggaugagcuaugcaaugugcacgaauaccuuuguguugaagaaagaagucucagaaacgcagcaugggacaauacucaucaaggucgaguacaaaggggaagaugcaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaauuuccuuaacguguucaaauacaauuuuuacguugacuguugccuggagaacagccacccugauuuuggccggaguuucgcuuuuaccagugugccagucuucgagcaugaggaaaacagacuggauuccaaugacaguggcagcuaugggaguuccaccucuaccacuuuuuauuuuuagcuuaaaagacacacucaaaaggagaaguuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuaucgccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagauagugggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaucagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguaugcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacaggugggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccgguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7606 - RNA, 9873 nt, Artificial Sequence
  derived and/or modified CDS sequence (wt) from DENV-3__FJ639774__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggaacuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcccacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucacuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaaaugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuugugcuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguggagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcguuugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaggaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacccgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuucucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguagaaccauggcuaaagaacaaccaauuuuguauuaaaguauugaacccuuacaugccagcugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaagcuuguggacagagaacgugaacuccacaaacugggcaaguguggaagcuguguuuacaacaugaugggcaagagagagaagaaacuuggagaguuuggcaaagcaaaaggcaguagagccauaugguacaugugguugggagccagguaccuugaguucgaagcccuuggauucuuaaaugaagaccacugguucucgcgugagaacucuuacaguggaguggaaggagaaggacugcacaagcuaggcuacauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacaggugggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7607 - RNA, 9873 nt, Artificial Sequence
  derived and/or modified CDS sequence (wt) from DENV-3__FJ639775__SS-prME
acaucgcucugucucaugaugauauugccagcagcacuugcuuuccacuugacuucacgagauggagagccgcgcaugauuguggggaagaaugaaagaggaaaaucccuacuuuucaagacagccucuggaauuaacaugugcacacucauagccauggacuugggagaaaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacgugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcacacauacguagacagaggcugggggaacggaugugguuuguuuggcaagggaagcuugguaacaugugcgaaauuucaaugccuggaaccaauagagggaaaaguggugcaauaugagaaccucaaguacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaagguugaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguuuugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaagcggaaucuucgucaccaacgagguccauaccuggacagagcaauacaaauuccaagcagacuccccaaaaagauuggcgacagcuauugcaggcgcuugggagaauggagugugcggaauuaggucaacaaccagaauggagaaucuccuguggaagcaaauagccaaugaacugaacuacauacugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaagcuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaauaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucucccuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguaccaauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuugacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucauaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccuggaucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacccguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuuugcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucacagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuucugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagagagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcacaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggcuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaagggaguggagagguuaaaaagaauggccauuagcggggaugauugcguagugaaaccaaucgaugacagguucgcuaaugcccugcucgcucugaacgauaugggaaagguucggaaagacauaccucaauggcagccgucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugccuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7608 - RNA, 9873 nt, Artificial Sequence
  derived and/or modified CDS sequence (wt) from DENV-3__FJ639777__SS-prME
acaucgcucugucucaugaugacauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaagcaucaacuacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaagagcuucuugugacauuuaaaaacgcacaugcgaaaaaacaagaaguaguuguccuuggaucgcaagagggagcaaugcacacugcauugacaggagccacagaaauccaaaacucaggagguacaagcauuuuugcggggcacuuaaaauguagacuuaagauggacaaauuagaacucaaggggaugagcuaugcaaugugcacgaauaccuuuguguugaaaaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuaggggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucaucacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauaguggcagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaacuugggaagaaacacaugauugcggggguuuucuucacguuuguacuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcucgugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacucaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugaacgcacaauggcaaaagggggaggaggugcagguuauugccguagagcccgggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauccaacuuagcaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaauaccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguuguuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauauagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaggccaaagaaggguugaaaagaggagaaauaacacaucaugccguguccagagguagcgcaaaacuucaaugguuuguggagagaaacauggucacucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaguccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggauccuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuucuggaaacuuguggacagagaacgugaacuccacagauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaauuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaucaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7609 - RNA, 9873 nt, Artificial Sequence
  derived and/or modified CDS sequence (wt) from DENV-3__FJ639778__SS-prME
acaucgcucugucucaugaugauauugccagcagcacuugcuuuccacuugacuucacgagauggagagccgcgcaugauuguggggaagaaugaaagagguaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggagaaucaccaacauaacaacugacucaagauguccuacccaaggggaagcgguuuugccugaggagcaggaccagaacuacguguguaagcauacauacguggacagaggcugggggaauggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauacugcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauaugguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccguucgugcacacuuccuccccugagauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugaccguugccuggagaacagccacccugauuuuggccggaguuucgcuuuuaccagugugccagucuucgagcaugaggaaaacagacuggcuuccaaugacaguagcagcuaugggaguuccaccucuaccacuuuuuauuuuuagcuuaaaagacacacucaaaaggagaagcuggccacugaaugaaggggugauggcuguugggcuugugagcauucuggccaguucucuccuuaaaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggacuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuagcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcgaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaccccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaauguccaaggagccagguguuguuucuccaaccagcuauuuagauguggacuugcacccagcaucagccuggacauuguacgcuguggccacuacaguaauaacaccaauguuaagacacaccauagagaauucuacagcaaaugugucccuggcagcuauagccaaccaggcagugguccugauggguuuggacaaaggauggccaauaucgaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagccguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugagaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauuaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaaccccauuuggccagcagagagucuuuaaagagaaaguggacaccaggacacccagguccaugccaggaacaagaaggguuauggggaucacagcggaguggcucuggagaaccuugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguuuucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaaucacacaaugguuggaaaccaaaggaguggagagguuaaaaagaauggccauuagcggggaugacugcguggugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacugauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacguggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucagcaggugagaagccuuauaggcaaugaagaguuucuggacuacaugccuucaaugaagagauuuaggaaggaggaggagucggagggagccauuugguaa

SEQ ID NO: 7610 - RNA, 9873 nt, Artificial Sequence
  derived and/or modified CDS sequence (wt) from DENV-3__FJ639779__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaaaggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuuugucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacuuugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccggcaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuauaggcaugcgguggaggaacuaccagagacaauggaaacacuccuacucuugggacucaugaucuuguugacagguggagcaaugcuuuucuuaauaucagguaaagggauuggaaagacuucaauaggacucauuugugugauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaagggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacaucgucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcuggcugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcuuccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagggaagaccaaugguguggaucacuuauuggucucacuuccagagcaaccugggcccagaacauacccacagcaauucaacaggugagaagccuuauaggcaaugaagaguuucuggacuacaugccugcaaugaagagauuuaggaaggaggaggagucggagggagccauuugguaa

SEQ ID NO: 7611 - RNA, 9873 nt, Artificial Sequence
  derived and/or modified CDS sequence (wt) from DENV-3__FJ639780__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccuuacaucaacaugggugacuuauggaacgugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggaacuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcccacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccauuuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaaaugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaauuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguggagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcguuugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaggaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacccgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuucucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguagaaccauggcuaaagaacaaccaauuuuguauuaaaguauugaacccuuacaugccagcugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaagcuuguggacagagaacgugaacuccacaaacugggcaaguguggaagcuguguuuacaacaugaugggcaagagagagaagaaacuuggagaguuuggcaaagcaaaaggcaguagagccauaugguacaugugguugggagccagguaccuugaguucgaagcccuuggauucuuaaaugaagaccacugguucucgcgugagaacucuuacaguggaguggaaggagaaggacugcacaagcuaggcuacauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacaggugggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucggcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7612 - RNA, 9873 nt, Artificial Sequence
  derived and/or modified CDS sequence (wt) from DENV-3__FJ639781__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccaauacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauacauucguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugggguucugaacucauuaggcaaaauggugcaccaaauauucggaagugcuuacacagcccuauucaguggagucucuuggguaaugaaaauuggaauaggaguucucuugacuuggauaggguugaauucaaaaaacauauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuagggaaauuagagcuggacuucaacuauugugaaggaacaacaguugucaucacagaaaacugugggacaagaggcccaucauugcgaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuugcacuccuucucucagggcaaauaacauggagagauauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuucacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuuggaaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagaccacaacaggggaaauaggagcaauugcacuggauuucaagccuggaaccucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuacaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaagguuauucaacuuaguaggaagacuuuugacacagaauaucagaaaacuaaauugaaugauugggacuuuguggugacgacugacauuucagaaaugggggccaauuucaaagcagauagagugaucgacccaagaagaugucucaaaccagucauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggauuauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugauggugcugcuuauaccagaaccagaaaagcagagaaccccccaagauaaccaacucgcauaugucgugauaggcauacuuacauuggcagcaacaauagcagccaacgaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcacuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaagggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccagaacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcuggcugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccaucagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuggcauccaacgccauauguucagcaguaccaguccacuggguccccacaaguagaacgacauggucuauucaugcucaccaucaguggaugacaacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7613 - RNA, 9873 nt, Artificial Sequence
  derived and/or modified CDS sequence (wt) from DENV-3__FJ639782__SS-prME
acaucgcucugucucaugaugauauugccagcagcacuugcuuuccacuugacuucacgagauggagagccgcgcaugauuguggggaagaaugagagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugauguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaaaauggacaaauuagaacucaaggggaugagcuaugcaaugugcacgaauaccuuuguguugaagaaagaaguuucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggauuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguugauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccgcugaaugaaggggugauggcuguugggcuugugagcauucuggccaguucucuccuuagaaaugacguacccauggcuggaccauuaguagccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguauugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagauagugggacuguauggcaauggagugguuacaaagaacgguggcuacgucagcggaauagcgcaaacgaaugcagaaccagauggaccgacaccagaauuggaagaagaaauguucaaaaaacgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugaucuuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaacaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuugggaguaccccugcuggcauuggguugcuauucacaagugaacccacugacucuaacagcggcaguacucuugcugaucacacauuaugcuauuauagguccaggauugcaggcaaaagccacucgugaagcucagaaaagaacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacucuacgcacgaaauguacuggauaucuaauggcacagguaacauugucgcuucagucaacaugguaucuagacugcuacugaacagguucacgaugacauacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugaugaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaaaauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccucauaggcaaugaagaguuucuggacuacaugccuucaaugaagagauuuaggaaggaggaggagucggagggagccauuugguaa

SEQ ID NO: 7614 - RNA, 9873 nt, Artificial Sequence
  derived and/or modified CDS sequence (wt) from DENV-3__FJ639785__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuucguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugggguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauugggguuuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccacaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuagggaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggauaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuucacguugacuguugccuggagaacagccacccugauuuuggccggaguuucgcuuuuaccagugugccagucuucgaguaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagugcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaagguuauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagucauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacggaagcaaaaaugcugcuggacaacauuaacacaccagaagggaucauaccagcucucuuugagccagaaagggagaagucagccgccauagacggugaguaucgccugaaaggugaguccaggaagaccuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcacacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaacaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcacuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuggauccuguaauauaugauucaaaauuugaaaagcaacugggacagguuaugcuccugguuuugugugcaguucagcuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacggggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaagggcgguccaggacacgaagaaccaguaccuauguccacauauggguggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaacaugguaucuagacugcuacugaacagguucacgaugacacacagaagaccuaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggauaccagaacacccagguccaugccaggaacaagaaggguuauggggaucacagcggaguggcucuggagaacccugggaaggaauaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagccauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcuggcugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcagcggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguacuuucacagaagagaccucagacuagcauccaacgccauauguucagcaguaccaguccacuggguccccacaaguagaacgacauggucuauucaugcucaccaucaguggaugacaacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7615 - RNA, 9873 nt, Artificial Sequence
  derived and/or modified CDS sequence (wt) from DENV-3__FJ639786__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggauacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaagguuuaucaggagccacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcacacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaauguucaccacggacagguuuggacuucaaugaaaugaucuugcuaacaaugaagaacaaagcauggaugguacauagacaaugguuuuuugaccuaccucuaccaugggcaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccaccgcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacggugguugugggcgauauaauugggguuuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcuaaaacuccgagagguguauacccaacuaugugaccauaggcuaaugucagcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggagcaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacaucagcggaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuauuauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagcuaguauagcugcuagaggguacauaucaacucguguuggaaugggagaagcagccgcaauuuucaugacagcaacacccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauaucagaaaugggggccaauuucaaaacagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaagaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuucuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagacuuaggaaugucuaaggagccagguguuguuucuccaaccagcuauuuagauguggacuugcacccagcaucagccuggacauuguacgcuguagccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuugggagaaaaauggaaaaagaaguuaaaucaauuaucccggagagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaauauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacggauacaacuccauuuggccagcagagagucuuuaaagagaaaguggacaccaggacacccaggcccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggguucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaucucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaccuagggaagagagaagaccaauggugcggaucacuuauuggucucacuuccagagcaaccugggcccagaacauauccacagcaauucaacaggugagaagccuuauaggcaaugaagaguuucuggacuacaugccuucaaugaagagauuuaggaaggaggaggagucggagggagccauuugguaa

SEQ ID NO: 7616 - RNA, 9873 nt, Artificial Sequence
  derived and/or modified CDS sequence (wt) from DENV-3__FJ639787__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccugguugucggcugaaggagcuuggaggcaaguugagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggaaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuucguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugggguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucaucacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuuuacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuucacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuacaggaucaaacagcaaggaaucuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagaucguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaagguuauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagucauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaacaauagcagccaaugaaaugggauugcuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcacuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuaucaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaagggcgguccaggacacgaagaaccaguacccauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauucggccagcagagagucuuuaaagagaaaguggacaccagaacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaguugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcuggcugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugacaacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7617 - RNA, 9873 nt, Artificial Sequence
  derived and/or modified CDS sequence (wt) from DENV-3__FJ639790__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcugguguaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggacauagagcuucagaagaccgaggccacccaacuggcgacccuaagaaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagccacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauaccuuucuccacagaggauggacaagggaaagcccacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacaucuaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaguacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggacgagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuuccucacguuuguacuccuucucucagggcaaauaacauggagagauauggcgcacacacuaauaaugauuggguccaacgcaucugacaggaugggaaugggcguuaccuaccuagcuuuaauugcaacauuuaagauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuaacuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagcccgggaagaacccaaagaacuuucaaaccaugccaggcacuuuucagacuacaacaggggaaauaggagcaaucgcacuagauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuaucguuagagaggcaaucaagagacguuugagaacucuaauucuggcaccgacaagggugguugcagcugagauggaagaagcauugaaaggacucccaauaagguaccaaacaacagcaacgaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauacacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcugauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaagaaccagguguuguuucuccaaccagcuauuuagauguggacuugcacccagcaucagccuggacauuguacgcuguggcuacuacaguaauaacaccaauguuaagacauaccauagagaauucuacagcaaaugugucccuggcagcuauagccaaccaggcagugguccugaugggcuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacccgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagagagacuacaaaggaaacauggaggaaugcuugugagaaauccacuuucacgaaacuccacgcacgaaauguacuggauaucuaauggcacagguaacauuguugcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcacaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauucaagcucacauaccaaaacaaaguggucaaaguucaacgaccgacuccagcaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucagggagcgggauggagucuuagagaaaccgcaugucugggaaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7618 - RNA, 9873 nt, Artificial Sequence
  derived and/or modified CDS sequence (wt) from DENV-3__FJ639791__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcugguguaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaauagagauuuuguggaaggucuaucaggagcuacguggguugacguggugcucgagcacggggggugugugaccaccauggcuaagaacaagcccacguuggacauagagcuucagaagaccgaggccacccaacuggcgacccuaagaaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaguagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagccacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauacuuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauugggguccuagagcaaggaaaaagaacacuaacaccacaacccauggagcuaaaauacucauggaaaacguggggaaaggcaaaaauagugacagcugaaacacaaaauucuucuuucauaauagauggaccaaauacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucacugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauucaaaauccagccauucuuggcuuugggauuuuuccuaagaaaacugacauccagagaaaauuuauuguuaggaguugggcuggcuauggcgacaacguuacaacugccagaggacauugaacaaauggcaaauggaaucgcucuggggcucauggcucuuaaacugauaacacaauuugaaauauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuaacuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcggaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaagggauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaaggacucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaagaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuagaaacuacaaagagagauuuaggaaugucuaaggaaccagguguuguuucuccaaccagcuauuuagauguggacuugcacccagcaucagccuggacauuguacgcuguggccacuacaguaauaacaccaauguuaagacacaccauagagaauucuacagcaaaugugucccuggcagcuauagccaaccaggcagugguccugaugggcuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggacgggauaaugacaauagaccuagauccuguaauauaugacucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaauaaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcucagguaacauuguugcuucagucaacaugguaucuagacugcuacugaacagguucacgaugacacacagaagacccaccauugagaaagauguggauuuaggagcaggaacucgacacguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguacgcugaugacacagcugguugggacacaagaauaacagaagaugaccugcacaacgaggaaaagaucacacagcaaauggacccugaacacaggcaguuagcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguggugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagucuuagagaaaccgcaugucuggggaaagccuacgcucaaauguggagucucauguauuuucacagaagagaccucagacuagcauccaaugccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7619 - RNA, 9873 nt, Artificial Sequence
  derived and/or modified CDS sequence (wt) from DENV-3__FJ639792__SS-prME
acaucgcuuugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacaugcaaucaagccggagagcauagacgcgauaagagaucaguggcguuagcuccccaugucggcaugggacuggacacacgcacccaaaccuggaugucggcugaaggagcuuggaggcaagucgagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuuggacuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguacccugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggggucucuuggguaaugaaaauuggaauaggaguucucuugacguggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacggagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauugggguuuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagaaagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacaguugccuggagaacagccacccugauuuuggccggagucucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauuuuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggggucuuucacaccauguggcacguuacaagaggggcaguguugacacauaaugggaaaagacuggaaccaaacugggcuagcgugaaaagagaucugauuucauacggaggaggauggagauugagcgcacaauggcaaaagggagaggaggugcagguuauugccguagagccugggaagaacccaaagaacuuucaaaccaugccaggcacuuuucagacuacaacaggggaaauaggagcaauugcacuggauuucaagccuggaaccucaggaucuccuaucauaaacagagagggaaagguagugggacuguauggcaauggaguggucacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaggaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagccuauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcaggaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuuuuuaauaucagguaaagggauuggaaagacuucaauaggacucauuuguguuauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcccagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagaaaaaguggacaccaggacacccagguccaugccaggaacaagaaggguuauggggaucacagcggaguggcucuggagaacccugggaaggaauaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaaaauacccggaggagcuauguaugcugaugacacagcugguugggacacaagaauaacagaagaugaccugcauaaugaggaaaagaucacacagcaaauggacccugaacacaggcaauuagcgaacgcuauauuuaagcucacauaucaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucuaccagagaagaaaaucacacaaugguuggaaaccaaaggaguggagagguuaaaaagaauggccauuagcggggaugauugcguagugaaaccaauugaugacagguucgcuaaugcccugcucgcucugaacgauaugggaaagguucggaaagacauaccucaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7620 - RNA, 9873 nt, Artificial Sequence
  derived and/or modified CDS sequence (wt) from DENV-3__FJ639793__SS-prME
acaucgcucugucucaugaugauauugccagcaacacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaaaaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugaaauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcagggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuaucgggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggaaaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggccuggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaccagugagaaagaagagaacaugguaaagucucuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaagacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagccaugggaguuccaccucuaccacuuuuuauuuuuagcuuaaaagacacacucaaaaggagaagcuggccacugaaugaaggggugauggcuguugggcuugugagcauucuggcuaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuuggaaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaagugcagguuauugccguagagccugggaagaacccaaagaacuuucaaaccaugccaggcacuuuucagaccacaacaggggaaauaggagcaauugcacuggauuucaagccuggaacuucaggaucuccuaucauaaacagagagggaaagauagugggacuguauggcaauggagugguuacaaagaaugguggcuacguuagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacggaaaaaaggucauucaacucaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcccuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaauguccaaggagccagguguuguuucuccaaccagcuauuuagauguggacuugcacccagcaucagccuggacauuguacgcuguggccacuacaguaauaacaccaauguuaagacauaccauagagaauucuacagcgaaugugucccuggcagcuauagccaaccaggcagugguccugauggguuuggacaaaggguggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuguuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacuguaauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaagaaagucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacaucuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaauccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggugccauuugguaa

SEQ ID NO: 7621 - RNA, 9873 nt, Artificial Sequence
  derived and/or modified CDS sequence (wt) from DENV-3__FJ639795__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagaaacgugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuucguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugggguucugaacucauuaggcaaaauggugcaccaaauauucggaagugcuuacacagcccuauucaguggagucucuuggguaaugaaaauuggaauaggaguucucuugacuuggauaggguugaacucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauugggguuuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcuuggaaugugugggagguggaagauuacggguucggagucuucacaaccaacauauggcugaaacuccgagagguguauacccaacuaugugaccacaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuagggaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggauaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcauuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuucacguugacuguugccuggagaacagccacccugauuuuggccggaguuucgcuuuuaccagugugccagucuucgaguaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugaugugcccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauaccugcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagugcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaagguuauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagucauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucauuggacggaagcaaaaaugcugcuggacaacauuaacacaccagaagggaucauaccagcucucuuugagccagaaagggagaagucagccgccauagacggugaguaucgccugaaaggugaguccaggaagaccuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcacacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaacaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcacuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuggauccuguaauauaugauucaaaauuugaaaagcaacugggacagguuaugcuccugguuuugugugcaguucagcuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacggggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaagggcgguccaggacacgaagaaccaguaccuauguccacauauggguggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaaccccuacaugccaacugugauugagcaccuagaaagacuacaaaggaaacauggaggaaugcuugugagaaauccacuuucacgaaacuccacgcacgaaauguacuggauauccaauggcacagguaacauugucgcuucagucaacaugguaucuagacugcuacugaacagguucacgaugacacacagaagaccuaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggauaccagaacacccagguccaugccaggaacaagaaggguuauggggaucacagcggaguggcucuggagaacccugggaaggaauaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagccauaugguacaugugguugggagccagguaccuugaguuugaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcuggcugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcagcggacagguaggaacuuauggucugaauacauucaccaacauggaagcccaguuaaucagacaaauggaaggagaaggugugcuguuaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguacuuucacagaagagaccucagacuagcauccaacgccauauguucagcaguaccaguccacuggguccccacaaguagaacgacauggucuauucaugcucaccaucaguggaugacaacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7622 - RNA, 9873 nt, Artificial Sequence
  derived and/or modified CDS sequence (wt) from DENV-3__FJ639798__SS-prME
acaucgcucugucucaugaugauacugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagccacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuagaaccaguagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaaugccuugaagaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggaaaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggcuguacaugccgacaugggcuauuggauagaaagccaaaagaauggaaguuggaagcuagaaaaagcaucccucauagaggugaaaaccugcacauggccaaagucacauacccuuuggagcaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuugugcuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucacuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaggcagaacuggaagaaggggucuauaggaucaaacagcaaggaauuuuuggaaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcagaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagcuaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucacugcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggauuauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaaucuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugcccacacaccuagcucauagaacgagaaacgcucuggacaaucuggugaugcugcacacgucagaacauggcgguaaggccuacaggcacgcgguggaggaacuaccagagacaauggaaacacuucuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaacaauagcagccaaugaaaugggauuguuggaaacuacaaagagagacuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguugaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggagagaguuugaccuuuacaagaaaucuggaaucacugaaguggauagaacagaagccaaagaaggguugaaaagaggagaaauaacacaccaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauacggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagauggucgaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauauuaaugcggaaccagaaacacccaacauggaugucauuggggaaagaauaaaaaggaucaaggaggagcauaauucaacauggcacuaugaugaagaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccaggcccaugccaggaacaagaaggguuauggggaucacagcggaguggcucuggagaacccugggaaggaacaaaaaacccagguuaugcacaagggaagaguuuacaaaaaaggucagaacuaacgcagcuaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacauguggcugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacacgaauaacagaagaugaccugcacaaugaggaaaagaucacacagcaaauggacccugaacacaggcaguuagcgaacgcuauauuuaagcucacauaccaaaacaaaguggucaaaguucaacggccgacuccaacaggcacgguaauggacaucauaucuaggaaagaccaaagaggcaguggacagguaggaacuuauggucugaacacauucaccaacauggaagcccaguuaaucagacaaauggaaggagaaggugugcugucaaaggcagaccucgaaaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguucacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuggggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7623 - RNA, 9873 nt, Artificial Sequence
  derived and/or modified CDS sequence (wt) from DENV-3__FJ639799__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaauagagauuuuguggaaggucuaucaggagcuacguggguugacguggugcucgagcacggggggugugugaccaccauggcuaagaauaagcccacguuggauauagagcuucagaagaccgaggccacccaacuggcgacccuaaggaagcuaugcauugaggggaaaaucaccaacguaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguauaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagaacaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguuuggagucuucacaaccaacauauggcugaaacuccgagaaguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacauguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuccaaacuacaacaggagaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccagucaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagccgaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuagggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcucgcuuucucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaggccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggacguguuuuaucuuccaccugaaaagugugacacccuguugugcgacauuggagaaucuucaccaagcccaacaguggaagaaagcagaacuauaagaguuuugaagaugguugaaccauggcuaaagaacaaccaauuuuguauuaaaguauugaacccuuauaugccagcugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggccagcagagagucuuuaaagagaaaguggacaccaggacacccagguccaugccaggaacaagaaggguuauggggauuacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7624 - RNA, 9873 nt, Artificial Sequence
  derived and/or modified CDS sequence (wt) from DENV-3__FJ639800__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcugguguaaccucacaucaacaugggugacuuacggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaauagagauuuuguggaaggucuaucaggagcuacguggguugacguggugcucgagcacggggggugugugaccaccauggcuaagaacaagcccacguuggacauagagcuucagaagaccgaggccacccaacuggcgacccuaagaaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagccacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaguccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugagaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauacuuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaguuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaauacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcgacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuaacuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcggaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguacccagcccuccagagacacagaaagcagaacuggaagaaggggucuauaggaucaaacagcaagggauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaaggacucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacccguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggauugcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggaaccagguguuguuucuccaaccagcuauuuagauguggacuugcacccagcaucagccuggacauuguacgcuguggccacuacaguaauaacaccaauguuaagacacaccauagagaauucuacagcaaaugugucccuggcagcuauagccaaccaggcagugguccugaugggcuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggacgggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaaguuacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcucagguaacauuguugcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaagaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugccuauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacaucuccaagauacccggaggagcuauguacgcugaugacacagcugguugggacacaagaauaacagaagaugaccugcacaacgaggaaaagaucacacagcaaauggacccugaacacaggcaguuagcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguggugaaaccaaucgaugacagguucgcuaaugcccugcucgcucugaacgauaugggaaagguucggaaagacauuccucaauggcagccaucaaagggauggcaugauuggcaacagguuccuuucugcucccaccacuuucaugaauugaucaugaaagauggaagaaaguuggugguucccugcagaccccaggacgaauuaauaggaagagcaagaaucucucaaggagcgggauggagucuuagagaaaccgcaugucuggggaaagccuacgcucaaauguggagucucauguauuuucacagaagagaccucagacuagcauccaaugccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7625 - RNA, 9873 nt, Artificial Sequence
  derived and/or modified CDS sequence (wt) from DENV-3__FJ639801__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaaguugagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuucguguugaagaaagaagucucagaaacgcagcaugggacaauacucaucaaggucgaguacaaaggggaagauguaccuugcaagauuccauucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugggguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuuuacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuucacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuacaggaucaaacagcaaggaaucuuugggaaaacccaaguagggguuggaguacagaaagaaggagucuuucacaccauguggcacguuacaagaggggcaguguugacauguaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagaucguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaagguuauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagucauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaacaauagcagcuaaugaaaugggauugcuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcacuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauacgauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuaucaugaaaucaguuggaacagggaaaagaggaacaggcucacagggugaaacuuuaggagaaaaauggaaaaagagguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaagggcgguccaggacacgaagaaccaguacccauguccacauauggauggaacauagucaaguuaaugaguggaaaggauguguuuuaucuuccaccugaaaagugugacacccuguugugugacauuggagaaucuucaccaagcccaacaguagaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaacccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauucggccagcagagagucuuuaaagagaaaguggacaccagaacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaguugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcuggcugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguuaggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacugggucccuacaaguagaacgacauggucuauucaugcucaccaucaguggaugacaacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7626 - RNA, 9873 nt, Artificial Sequence
  derived and/or modified CDS sequence (wt) from DENV-3__KF955471__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcugguguaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaauagagauuuuguggaaggucuaucaggagcuacguggguugacguggugcucgagcacggggggugugugaccaccauggcuaagaacaagcccacguuggacauagagcuucagaagaccgaggccacccaacuggcgacccuaagaaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagccacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaagguugaguacaaaggggaagauguaccuugcaagauuccuuucuccacagaggauggacaagggaaagcucacaauggcagacugauuacggccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauagggguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauacuuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaauacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggcuguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucacugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcaggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauucaaaauccagccauucuuggcuuugggauuuuuccuaagaaaacugacauccagagaaaauuuauuguuaggaguugggcuggcuauggcgacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuaacuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcggaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauagugucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaagggauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguaauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaaggacucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacggaaaaaaggucauucaacuuaguaggaagacuuuugacacagaauaucagaaaacuaaacugaaugauugggacuuuguggugacaacugacauuucagaaaugggagccaauuucaaagcagauagagugaucgacccaagaagaugucucaaaccagugauucugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaagaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcgguauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuagaaacuacaaagagagauuuaggaaugucuaaggaaccagguguuguuucuccaaccagcuauuuagauguggacuugcacccagcaucagccuggacauuguacgcuguggccacuacaguaauaacaccaauguuaagacacaccauagagaauucuacagcaaaugugucccuggcagcuauagccaaccaggcagugguccugaugggcuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggacgggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcucagguaacauuguugcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguacgcugaugacacagcugguugggacacaagaauaacagaagaugaccugcacaacgaggaaaagaucacacagcaaauggacccugagcacaggcaguuagcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcgugguaaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagucuuagagaaaccgcaugucuggggaaagccuacgcucaaauguggagucucauguauuuucacagaagagaccucagacuagcauccaaugccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7627 - RNA, 9873 nt, Artificial Sequence
  derived and/or modified CDS sequence (wt) from DENV-3__FJ639803__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcugguguaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaauagagauuuuguggaaggucuaucaggagcuacguggguugacguggugcucgagcacggggggugugugaccaccauggcuaagaacaagcccacguuggacauagagcuucagaagaccgaggccacccaacuggcgacccuaagaaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagccacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaagguugaguacaaaggggaagauguaccuugcaagauuccuuucuccacagaggauggacaagggaaagcucacaauggcagacugauuacggccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauagggguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauacuuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaauacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggcuguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucacugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcaggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauucaaaauccagccauucuuggcuuugggauuuuuccuaagaaaacugacauccagagaaaauuuauuguuaggaguugggcuggcuauggcgacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuaacuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcggaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauagugucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaagggauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguaauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaaggacucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacggaaaaaaggucauucaacuuaguaggaagacuuuugacacagaauaucagaaaacuaaacugaaugauugggacuuuguggugacaacugacauuucagaaaugggagccaauuucaaagcagauagagugaucgacccaagaagaugucucaaaccagugauucugacagauggaccagagcgggugauccuggcuggaccaaugccagucaccgcggcgagugcugcgcaaaggagagggagaguuggcaggaacccacaaaaagaaaaugaccaauacauauucacgggccagccucucaacaaugaugaagaccaugcucacuggacagaagcaaagaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauuguuuccagcgguauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuagaaacuacaaagagagauuuaggaaugucuaaggaaccagguguuguuucuccaaccagcuauuuagauguggacuugcacccagcaucagccuggacauuguacgcuguggccacuacaguaauaacaccaauguuaagacacaccauagagaauucuacagcaaaugugucccuggcagcuauagccaaccaggcagugguccugaugggcuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggacgggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcucagguaacauuguugcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguacgcugaugacacagcugguugggacacaagaauaacagaagaugaccugcacaacgaggaaaagaucacacagcaaauggacccugagcacaggcaguuagcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcgugguaaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagucuuagagaaaccgcaugucuggggaaagccuacgcucaaauguggagucucauguauuuucacagaagagaccucagacuagcauccaaugccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7628 - RNA, 9873 nt, Artificial Sequence
  derived and/or modified CDS sequence (wt) from DENV-3__FJ639804__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauaucaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugauguggugcucgagcacggggggugugugaccaccauggcuaagaacaaacccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugacuuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaaaauggacaaauuagaacucaaggggaugagcuaugcaaugugcacgaauaccuuugugcugaagaaagaaguuucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaaaagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguugauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccgcugaaugaaggggugauggcuguugggcuugugagcauucuggccaguucucuccuuagaaaugacguacccauggcuggaccauuaguagccgggggcuugcugauagcguguuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaagccaaguagggguuggaguacagaaagaaggagucuuucacaccauguggcacguuacaagaggggcaguauugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagauagugggacuguauggcaauggagugguuacaaagaacgguggcuacgucagcggaauagcgcaaacgaaugcagaaccagauggaccgacaccagaauuggaagaagaaauguucaaaaaacgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucagguaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaaggaauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaacaauagcagccaaugaaaugggauuguuggaaacuacaaagagagauuuaggaauguccaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuugggaguaccccugcuggcauuggguugcuauucacaagugaacccacugacucuaacagcggcaguacucuugcugaucacacauuaugcuauuauagguccaggauugcaggcaaaagccacucgugaagcucagaaaagaacagcugcuggaauaaugaagaauccaacgguggaugggauaaugacaauagaccuagauccuguaauauaugauucaaaauuugaaaagcaacugggacaaguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuaucaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacucuacgcacgaaauguacuggauaucuaauggcacagguaacauugucgcuucagucaacaugguaucuagacugcuacugaacagguucacgaugacauacagaagacccaccauugagaaagauguggauuuaggagcaggaacucgacauguuaaugcggaaccagaaacacccaacauggaugucauuggggaaagaauagaaaggaucaaggaggagcauaauucaacauggcacuaugaugaugaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccagaauacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagccauaugguacaugugguugggagccagguaccuugaguucgaagcccuuggauucuuaaaugaagaccacugguucucgcgugagaacucuuacaguggaguggaaggagaaggacugcacaagcuaggcuauauacuaagggacauuuccaaaauacccggaggagcuauguaugcugaugacacagcugguugggacacaagaauaacagaagaugaccugcacaaugaggaaaagaucacacagcaaauggacccugaacacaggcaguuagcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaagaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccucauaggcaaugaagaguuucuggacuacaugccuucaaugaagagauuuaggaaggaggaggagucggagggagccauuugguaa

SEQ ID NO: 7629 - RNA, 9873 nt, Artificial Sequence
  derived and/or modified CDS sequence (wt) from DENV-3__FJ639805__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauaucaccgaaguggaaccugaagacauugacugcugguguaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggacauagagcuucagaagaccgaggcuacccaacuggcgacccuaagaaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagccacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcccacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucuuggagcuguagugcaagcugacaugggguguguuauaaacuggaaagguaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaguacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgcgagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcuggucccaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuuccucacguuuguacuccuucucucagggcaaauaacauggagagauauggcgcacacacuaauaaugauuggguccaacgcaucugacaggaugggaaugggcguuaccuaccuagcuuuaauugcaacauuuaagauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccuuuaccacuuuuuaucuuuaacuuaaaagacacacucagaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuagauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuaucguuagagaggcaaucaagagacguuugagaacucuaauucuggcaccgacaagggugguugcagcugagauggaagaagcacugaaaggacucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaucaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauacacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcggcaaggccuacaggcaugcgguggaggaacuaccagagacaauggaaacacuccuacucuugggacucaugaucuuguugacagguggagcaaugcuuuucuuaauaucagguaaagggcuuggaaagacuucaauaggacucauuuguguaauugcuuccagcggcauguuguggauggccgaaaucccacuccaauggaucgcgucggccauaguccuggaguuuuuuaugaugguguugcugauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaagaaccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugaugggcuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacccgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauccccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagagagacuacaaaggaaacauggaggaaugcuugugagaaauccacuuucacgaaacuccacgcacgaaauguacuggauaucuaauggcacagguaacauuguugcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcacaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugauacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucagggagcgggauggagucuuagagaaaccgcaugucugggaaaagccuacgcucaaauguggagucucauguauuuucacagaagagaccucagauuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7630 - RNA, 9873 nt, Artificial Sequence
  derived and/or modified CDS sequence (wt) from DENV-3__FJ639807__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaaguugagaagguagaaacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucaaccacugaagcuaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuucguguugaagaaagaagucucagaaacgcagcaugggacaauacucaucaaggucgaguacaaaggggaagauguaccuugcaagauuccauucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugggguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuauggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuuuacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuucacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuacaggaucaaacagcaaggaaucuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagaucguugaucugaugugccacgcaacguucacaaugcgucugcugucaccaguuaggguuccaaacuauaacuugauaauaauggaugaagcccauuucacagacccagccagcauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaagguuauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagucauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaagaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaacaauagcagcuaaugaaaugggauugcuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcacuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauacgauucaaaauuugaaaagcaacugggacagguuaugcuccugguuuugugugcaguucaacuuuuguuaaugagaacaucaugggccuugugugaagcuuuaacucuagccacaggaccaauaacaacacucugggaaggaucaccugggaaguuuuggaacaccacgauagcuguuuccauggcgaacauuuuuagagggagcuauuuagcaggagcugggcuugcuuuuucuaucaugaaaucaguuggaacagggaaaagaggaacaggcucacagggugaaacuuuaggagaaaaauggaaaaagagguuaaaucaauuaucccggaaagaguuugaccuuuacaagaaaucuggaaucacugaaguggauagaacagaagccaaagaaggguugaaaaggggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaagggcgguccaggacacgaagaaccaguacccauguccacauauggauggaacauagucaaguuaaugaguggaaaggauguguuuuaucuuccaccugaaaagugugacacccuguugugugacauuggagaaucuucaccaagcccaacaguagaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauucggccagcagagagucuuuaaagagaaaguggacaccagaacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaguugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacaucuccaagauacccggaggagcuauguaugcugaugacacagcuggcugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguugaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacugggucccuacaaguagaacgacauggucuauucaugcucaccaucaguggaugacaacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7631 - RNA, 9873 nt, Artificial Sequence
  derived and/or modified CDS sequence (wt) from DENV-3__FJ639810__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggauacacgcacccaaacuuggaugucggcugaaggagcuuggaggcaaguugagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccaaaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguucuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagaucccuuucuccacagaggauggacaagggaaagcucacaauggcagacugauuacagccaacccaguggugacuaagaaggaggagccugucaauauugaggcugaaccuccuuuuggggaaagcaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucaucacacucuaucugggagcuguggugcaagcugacacgggguguguuauaaacuggaaaggcaaagaacucaaguguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguuguugugggcgauauaauuggggucuuagagcaagggaaaagaacacuaacaccacaacccauggagcuaaaauacucauggaaaacguggggaaaggcaagaauagugacagcugaaacacaaaauucuucuuucauaauagauggaccaaacacaccggaguguccaaauaccucaagagcauggaaugugugggagguggaagauuacggguucggagucuucacaaccaacauauggcugaaacuccgagagguguauacccaacuaugugaccauaggcuaaugucggcagccguuaaggaugaaagggccguacaugcugacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuuauucacguuuguacuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaauugauaacacaauuugaaacauaccaauuauggacagcauuaaucuccuuaacguguucgaauacaauuuucacguugacuguugccuggagaacagccacccugauuuuggccggaguuucacuuuuaccagugugccagucuucgagcaugaggaaaacagacuggcuuccaaugacaguggcagcuaugggaguuccaccucuaccacuuuuuauuuuuugcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuucugaaaacagcauuacuaauaguaucaggaaucuuuccauacuccauacccgcaacauuguuggucuggcauacuuggcaaaagcaaacccaaagauccggcguucuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguagagccugggaagaacccaaagaacuuucagaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcagacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccaacaaggguggucgcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauauucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaauugccugcgaaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcagcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucaugccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcucgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagcuacccgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacccuagcuacaggaccaauaacaacacucugggaaggaucaccugggaaguuuuggaacaccacgauagcuguuuccauggcgaacauuuuuagagggagcuauuuagcaggagcugggcuugcuuucucuauuaugaaaucaguuggaacagggaaaagaggaacaggcucacagggugaaacuuugggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagugcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccagcugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagcuguuuucacagaggagaaccaaugggacagcgcgaaagcugcuguugaggaugaggauuuuuggaaacuuguggacagagaacgugaacuccacaaacugggcaaauguggaagcuguguuuacaacaugauggguaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccuguacaaugaggaaaagaucacacagcaaauggacccugaacacaggcaguuagcgaacgcuauauuuaagcucacauaccaaaacaaaguggucaaaguucaacgaccgacuccaacaggcacgguaauggauaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucacgcucaccaucaguggaugaccacggaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7632 - RNA, 9873 nt, Artificial Sequence
  derived and/or modified CDS sequence (wt) from DENV-3__FJ639816__SS-prME
acaucgcucugucucaugaugauauugccagcaacacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaaaaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggaaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugaaauaacaccucaggcaucaaccacugaagccaucuugccugaauauggaacucuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcagggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggaugaacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucaucacacucuaucugggagccguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggaaaauggagugugcggaauuaggucaacaaccagaauggagaaucuccuguggaagcaaauagccaaugaacugaacuacauauugugggaaaacaauaucaaauuaacgguaguugugggcgacauaauuggggucuuagagcaaggaaaaagaacacuaacaccacaacccauggagcuaaaauacucauggaaaacguggggaaaggcaagaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacacacccuuuggaguaaugguguguuagagagugacaugaucauuccaaagagucuagcugguccuaucucgcaacacaacuacaggccuggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggccauggcaacaacguuacaacugccagaagacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagccaugggaguuccaccucuaccacuuuuuauuuuuagcuuaaaagacacacucaaaaggagaagcuggccucugaaugaagggguaauggcuguugggcuugugagcauucuggcuaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauauuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuuggaaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaagugcagguuauugccguagagccugggaagaacccaaagaacuuucaaaccaugccaggcacuuuucagaccacaacaggggaaauaggagcaauugcacuggauuucaagccuggaacuucaggaucuccuaucauaaacagagagggaaagauagugggacuguauggcaauggagugguuacaaagaaugguggcuacgucagcggaauagcgcaaacgaaugcagaaccagauggaccgacaccagaauuggaagaagagauguucaaaaaacgaaaucuaacuauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacggaaaaaaggucauucagcucaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggacguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcccuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcucauaccagaaccagaaaagcagagaaccccccaagacaaccaacucgcauauguagugauaggcauacuuacauuggcagcaacaauagcagccaaugaaaugggauuguuggaaacuacaaagagagauuuaggaauguccaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggguggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuguuaugaaaucaguuggaacagggaaaagaggaacaggcucacagggcgaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaagcuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacuguaauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccaggucuaugccaggaacaagaaggguuauggggaucacagcggaguggcucuggagaacccugggaaggaacaaaaaacccagguuaugcacaagggaagaguuuacaaaaaaagucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacaucuccaagauacccggaggagcuauguaugcugacgacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaauccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccuguagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggugccauuugguaa

SEQ ID NO: 7633 - RNA, 9873 nt, Artificial Sequence
  derived and/or modified CDS sequence (wt) from DENV-3__FJ639817__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuucauacuacuaaugcuggucaccccauccaugacaaugagaugugugggaguaggaaauagagauuuuguggaaggucuaucaggagcuacguggguugacguggugcucgagcacggggggugugugaccaccauggcuaagaauaagcccacguuggauauagagcuucagaagaccgaggccacccaacuggcgacccuaaggaagcuaugcauugaggggaaaaucaccaacguaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcgggacacuuaaaauguagacuuaagauggacaaauuagaacucaaggggaugagcuaugcaaugugcacgaauaccuuuguguugaagaaagaagucucagaaacgcagcaugggacaauacucaucaaggucgaguauaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcaugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaagaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagaacaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguuuggagucuucacaaccaacauauggcugaaacuccgagaaguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuauguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaaucuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuugacauguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccgcugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaggaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuccaaacuacaacaggagaaauaggagcaauugcacuggauuucaagccuggaacuucaggaucuccuaucauaaacagagagggaaagguagugggucuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccagucaggguuccaaacuauaacuugauaauaauggaugaagcccacuucacagacccagccaguauagcugcuagaggguacauaucaacucguguuggaaugggagaagcagccgcaauuuucaugacagcaacgcccccuggaacagccgaugccuuuccucagagcaacgcuccaauucaagaugaagaaagggacauaccagaacgcucauggaauucaggcaaugaauggauaaccgacuucgcugggaaaacggugugguuuguccccagcaucaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuagggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucacccgggaaguuuuggaacaccacgauagcuguuuccauggcgaacauuuuuagagggagcuauuuagcaggagcugggcucgcuuucucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaggccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacggaagugcgaggauacacaaaaggcgguccaggacacgaagaaccaguaccuauguccacauauggauggaacauagucaaguuaaugaguggaaaggacguguuuuaucuuccaccugaaaagugugacacccuguugugcgacauuggagaaucuucaccaagcccaacaguggaagaaagcagaacuauaagaguuuugaagaugguugaaccauggcuaaagaacaaccaauuuuguauuaaaguauugaacccuuauaugccagcugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagacacaacuccauuuggucagcagagagucuuuaaagagaaaguggacaccaggacacccagguccaugccaggaacaagaaggguuauggggauuacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguccaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccuacucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7634 - RNA, 9873 nt, Artificial Sequence
  derived and/or modified CDS sequence (wt) from DENV-3__FJ639825__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaaucaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaauggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggaacuucuugugacauuuaaaaacgcacaugcgaaaaaacaagaaguaguuguccuuggaucgcaagagggagcaaugcauacugcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgacuacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaauuaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagcgccucaagagcauggaaugugugggagguggaagauuacggguucggagucuucacaaccaacauauggcugaaacuccgagagguguauacccaacaaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacagucgucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauucaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccggaggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuagucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggagguacagguuauugccguagagccugggaagaacccaaagaacuuucaaacuaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagccgaugccuuuccucagagcaacgcuccaauucaagaugaagaaagggacauaccagaacgcucauggaauucaggcaaugaauggauaaccgacuuugcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugauugacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacaucaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcuaugcuuuucuuaauaucaggcaaagggauuggaaagacuucaauaggacucauuuguguaaucgcuuccaguggcauguuguggauggccgaaaucccacuccaauggaucgcgucggccauaguccuggaguuuuuuaugauggugcugcucauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguucugauggguuuggacaaaggauggccaauaucaaaaauggacuuaggaguaccccugcuggcauuagguugcuauucacaagugaacccacugacucuaacagcggcaguacucuugcugaucacacauuaugcuauuauagguccaggacugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccaucgagaaagauguggauuuaggagcaggaacucgacauguuaaugcggaaccagaaacacccaacauggaugucauuggggaaagaauaaaaaggaucaaggaggagcauaauucaacauggcauuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaagcccagguugugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaagcaguuagcgaacgcuauauuuaaacucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7635 - RNA, 9873 nt, Artificial Sequence
  derived and/or modified CDS sequence (wt) from DENV-3__FJ639826__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggauacacgcacccaaacuuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacugcuaaugcuggucaccccauccaugacaaugagaugugugggaguaggaaacagagauuuuguggaaggacuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccaaaacuacguguguaagcauacauacguagacagaggcugggggaacggaugugguuuguuugguaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguucuugggucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacuuaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucaucacacucuaucugggagcuguggugcaagcugacacgggguguguuauaaacuggaaaggcaaagaacucaaguguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguuguugugggcgauauaauuggggucuuagagcaagggaaaagaacacuaacaccacaacccauggagcuaaaauacucauggaaaacguggggaaaggcaagaauagugacagcugaaacacaaaauucuucuuucauaauagauggaccaaacacaccggaguguccaaauaccucaagagcauggaaugugugggagguggaagauuacggguucggagucuucacaaccaacauauggcugaaacuccgagagguguauacccaacuaugugaccauagguuaaugucggcagccgucaaggaugaaagggccguacaugccgacaugggcuauuggauagaaagucaaaagaauggaaguuggaagcuagaaaaagcaucccucauagaggugaaaaccugcacauggccaaaaucacauacccuuuggaguaaugguguguuagagagugacaugaucauuccaaaaagucuagcugguccuaucucgcaacacaacuacaggcccggguaccacacccagacggcgggaccuuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagaaaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaaugcaacugacaggaugggaaugggcgucaccuaccuagcuuuaauugcaacauuuaaaauccagccauuuuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucucaaacugauaacacaauuugaaacauaccaacuauggacagcauuaaucuccuuaacguguucaaauacaauuuuuacguugacuguugccuggagaacagccacccugauuuuggcuggaguuucacuuuuaccagugugccagucuucgaguaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauagugucaggaaucuuuccauacuccauacccgcaacauuguuggucuggcauacuuggcaaaagcaaacccaaagauccggcguucuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagcccggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccaacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauauucaugacagcaacgcccccuggaacagcugaugccuuuccccagagcaacgcuccaauucaagaugaagaaagggacauaccagaacgcucauggaauucaggcaaugaauggauaaccgacuucacugggaaaacggugugguuuguccccagcauuaaagccggaaaugacauagcaaauugccugcggaaaaacgggaaaaaggucauucaacuuaguaggaagacuuuugacacagaauaucagaaaaccaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcagcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcucgcaccuauucagaucccuuagcacucaaggaauucaaggacuuugcggcuggcaggaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacacuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauuccacagcaaauguguccuuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugccauuauagguccaggauugcaggcaaaagccacccgugaagcucagaaaaggacagcugcuggaauaaugaagaauccaacaguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacccuagcuacaggaccaauaacaacacucugggaaggaucaccugggaaguuuuggaacaccacgauagcuguuuccauggcgaacauuuuuagagggagcuauuuagcaggagcugggcuugcuuucucuauuaugaaaucaguuggaacagggaaaagaggaacaggcucacagggugaaacuuugggagaaaaauggaaaaagaaguuaaaucaauuaucccggaaagaguuugaccuuuacaagaaaucuggaaucacugagguggauagaacagaagccaaagaaggguugaaaagaggagaaauaacacaucaugccguguccagagguagugcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugcgacauuggagaaucuucaccaagcccaacaguggaagaaagcagaacuauaagaguuuugaagaugguugaaccauggcuaaagaacaaccaauuuuguauuaaaguauugaacccuuacaugccagcugugauugagcaccuagaaagacuacaaaggaaacauggaggaaugcuugugagaaauccacuuucacgaaacuccacgcacgaaauguacuggauauccaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuacgaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggagaucacagcggaguggcucuggagaacccugggaaggaauaaaaaacccagguuaugcacaagggaagaguuuacaaaaaaggucagaacuaacgcagccaugggagcuguuuucacagaggagaaccaaugggacagcgcgaaagcugcuguugaggaugaggauuuuuggaaacuuguggacagagaacgugaacuccacaaacugggcaaguguggaagcuguguuuacaacaugauggguaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggauaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauaaguggggaugacugcguggugaaaccaaucgaugacagguucgcuaaugcccugcucgcucugaacgacaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucacgcucaccaucaguggaugaccacagaagacaugcuuacugucuggaacagaguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacagguuagaagccuuauaggcaaugaagaguuucuggacuacaugccuucaaugaagagauuuaggaaggaggaggagucggagggagccauuugguaa

SEQ ID NO: 7636 - RNA, 9873 nt, Artificial Sequence
  derived and/or modified CDS sequence (wt) from DENV-3__FJ810416__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaacggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcaucgcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucaucccaaagagucuagcugguccuaucucgcaacacaacuacaggcccggguaccacacccagacggcgggacccuggcauuuaggaaaauuagagcuggacuucaauuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggauaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuuguugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcacacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuuaugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgagaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugguugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuugggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucgucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccaaucacaaccugggaaaauguuccauaucuagggaagagagaagaccaauggugcggaucacucauuggucucacuucuagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7637 - RNA, 9873 nt, Artificial Sequence
  derived and/or modified CDS sequence (wt) from DENV-3__GQ252678__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacaugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacuuaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggggucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacaggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucggccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaggcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaccuagggaagagagaagaccaauggugcggaucacuuauuggucucacuuccagagcaaccugggcccagaacauauccacagcaauucaacaggugagaagccuuauaggcaaugaagaguuucuggacuacaugccuucaaugaagagauuuaggaaggaggaggagucggagggagccauuugguaa

SEQ ID NO: 7638 - RNA, 9873 nt, Artificial Sequence
  derived and/or modified CDS sequence (wt) from DENV-3__FJ850098__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacacagcaugggacaauacucaucaaggucgaguacaaaggggaagauguaccuugcaagauuccuuucuccacagaggauggacaagggaaagcucacaauggcagacugauuacagccaacccaguggugacuaagaaggaggauccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacucccccaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauguaauuggggucuuagagcaaggaaaaagaacacuaacacuacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggauuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacucaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauagucuuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgagaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacggaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugguugagcaccuagaaagacuacaaaggaaacauggaggaaugcuugugagaaauccacuuucacgaaacuccacgcacgaaauguacuggauaucuaauggcacaggcaacauugucgcuucagucaacaugguaucuagacugcugcugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucgucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacucauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7639 - RNA, 9873 nt, Artificial Sequence
  derived and/or modified CDS sequence (wt) from DENV-3__KF955479__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucucgcccauuacauaggcacuuccuugacccagaaggugguuauuuuuauacuacuaaugcugguuaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggauguggcuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcauccuucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcuaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauagugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaagucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcuugcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7640 - RNA, 9873 nt, Artificial Sequence
  derived and/or modified CDS sequence (wt) from DENV-3__FJ850109__SS-prME
acaucgcucugucucaugaugauauugccagcagcacuugcuuuccacuugacuucacgagauggagagccgcgcaugauuguggggaagaaugaaagaggaaaaucccuacuuuucaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggauacacgcacccaaacuuggaugucggcugaaggagcuuggaggcaagucgagaagguagagacaugggcccuuaggcacccaggguucaccauacuagcccuauuucuugcccauuacacaggcacuuccuugacccagaaggugguuauuuuuauacugcuaaugcuggucaccccauccaugacaaugagaugugugggaguaggaaacagagauuuuguggaaggacuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccaaaacuacguguguaagcauacauacguagacagaggcugggggaacggaugugguuuguuugguaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguucuugggucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacuuaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaauauaguaauuggaauuggagacaacuccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucaucacacucuaucugggagcuguggugcaagcugacacgggguguguuauaaacuggaaaggcaaagaacucaaguguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguuguugugggcgauauaauuggggucuuagagcaagggaaaagaacacuaacaccacaacccauggagcuaaaauacucauggaaaacguggggaaaggcaagaauagugacagcugaaacacaaaauucuucuuucauaauagauggaccaaacacaccggaguguccaaauaccucaagagcauggaaugugugggagguggaagauuacggguucggagucuucacaaccaacauauggcugaaacuccgagagguguauacccaauuaugugaccauaggcuaaugucggcagccgucaaggaugaaagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggaccuuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaaugcaacugacaggaugggaaugggcgucaccuaccuagcuuuaauugcaacauuuaaaauccagccauuuuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggcuggaguuucacuuuuaccagugugccagucuucgaguaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcugaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacgggggaaauaggagcaauugcacuggauuucaagcccggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccaacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauauucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaauugccugcggaaaaacgggaaaaaggucauucaacuuaguaggaagacuuuugacacagaauaucagaaaaccaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcagcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcucgcaccuauucagauccccuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuauaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguugagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuacgccauuauagguccaggauugcaggcaaaagccacccgugaagcucagaaaaggacagcugcuggaauaaugaagaauccaacaguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacccuagcuacaggaccaauaacaacacucugggaaggaucaccugggaaguuuuggaacaccacgauagcuguuuccauggcgaacauuuuuagagggagcuauuuagcaggagcugggcuugcuuucucuauuaugaaaucaguuggaacagggaaaagaggaacaggcucacagggugaaacuuugggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagugcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguucuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccagcugugauugagcaccuagaaagacuacaaaggaaacauggaggaaugcuugugagaaauccacuuucacgaaacuccacgcaugaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugauacagauggcaaugacagauacaacuccauuuggccagcagagagucuuuaaagagaaaguggacaccaggacacccagguccaugccaggaacaagaaggguuauggagaucacagcggaguggcucuggagaacccugggaaggaauaaaaaacccagguuaugcacaagggaagaguuuacaaaaaaggucagaacuaacgcagccaugggagcuguuuucacagaggagaaccaaugggacagcgcgaaagcugcuguugaggaugaggauuuuuggaaacuuguggacagagaacgugaacuccacaaacugggcaaguguggaagcuguguuuacaacaugauggguaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggauaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucacgcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuauaugccuucaaugaagagauuuaggaaggaggaggaaucggagggagccauuugguaa

SEQ ID NO: 7641 - RNA, 9873 nt, Artificial Sequence
  derived and/or modified CDS sequence (wt) from DENV-3__GQ868586__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaaucaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaauggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggaacuucuugugacauuuaaaaacgcacaugcgaaaaaacaagaaguaguuguccuuggaucgcaagagggagcaaugcauacugcauugacaggagccacagaaauccaaaacucaggaggcacaagcauuuuugcggggcacuuaaaauguagacuuaagauggacaaauuagaacucaaggggaugagcuaugcuaugugcacgaauaccuuuguguugaagaaagaagucucagaaacgcagcaugggacaauacucaucaaggucgacuacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaauuaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcaauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagcuaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagcgccucaagagcauggaaugugugggagguggaagauuacggguucggagucuucacaaccaacauauggcugaaacuccgagagguguauacccaacaaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacagucgucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauucaaaauccagccauucuuggcuuugggauuuuuccuaagaaaacugacauccagagaaaauuuauugcuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuuguaagcauucuggccaguucucuccuuagaaaugauguacccauggcuggaccauuaguggccggaggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauaccagcaacauuguuagucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggagguacagguuauugccguagagccugggaagaacccaaagaacuuucaaacuaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagccgaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugauugacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacaucaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcuaugcuuuucuuaauaucaggcaaagggauuggaaagacuucaauaggacucauuuguguaaucgcuuccaguggcauguuguggauggccgaaaucccacuccaauggaucgcgucggccauaguccuggaguuuuuuaugauggugcugcucauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguucugauggguuuggacaaaggauggccaauaucaaaaauggacuuaggaguaccccugcuggcauuagguugcuauucacaagugaacccacugacucuaacagcggcaguacucuugcugaucacacauuaugcuauuauagguccaggacugcaggcaaaagccacucgugaagcucagaaaaggacagcugcuggaauaaugaagaauccaacgguggaugggauaaugacaauagaccuagaucccguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaguaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccaucgagaaagauguggauuuaggagcaggaacucgacauguuaaugcggaaccagaaacacccaacauggaugucauuggggaaagaauaaaaaggaucaaggaggagcauaauucaacauggcauuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaagcccagguugugcacaagggaagaguuuacaaaaaaggucagaacuaacgcagccaugggagccguuuucacagaggagaaccaaugggacagcgcgaaagcugcuguugaggaugaggauuuuuggaaacuuguggagagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaagcaguuagcgaacgcuauauuuaaacucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaaucacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagaugggagaaaguuggugguucccugcagaccccaggacgaacuaauaggaagagcaagaaucucucaaggagcgggauggagccuuagagaaaccgcaugucuggcgaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7642 - RNA, 9873 nt, Artificial Sequence
  derived and/or modified CDS sequence (wt) from DENV-3__FJ850110__SS-prME
acaucgcucugucucaugaugauauugccagcagcacuggcuuuccacuugacuucacgagauggagagccgcgcaugauuguggggaagaaugaaagaggaaaaucccuacuuuuuaagacagccucuggaauuaacaugugcacacucauagccauggaccugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggauacacgcacccaaacuuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacugcuaauguuggucaccccauccaugacaaugagaugugugggaguaggaaacagagauuuuguggaaggacuaucaggagcuacguggguugacguggugcucgagcacggggggugugugaccaccauggcuaagaacaaacccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccaaaacuacguguguaagcauacauacguagacagaggcugggggaacggaugugguuuguuugguaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguucuugggucgcaagagggagcaaugcauacugcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacuuaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucaucacacucuaucugggagcuguggugcaagcugacacgggguguguuauaaacuggaaaggcaaagaacucaaguguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguuguugugggcgauauaauuggggucuuagagcaagggaaaagaacacuaacaccacaacccauggagcuaaaauacucauggaaaacguggggaaaggcaagaauagugacagcugaaacacaaaauucuucuuucauaauagauggaccaaacacaccggaguguccaaauaccucaagagcauggaaugugugggagguggaagauuacggguucggagucuucacaaccaacauauggcugaaacuccgagagguguauacccaacuaugugaccauaggcuaaugucggcagccgucaaggaugaaagggccguacaugccgacaugggcuauuggauagaaagccaaaagaauggaaguuggaagcuagaaaaagcaucccucauagaggugaaaaccugcacauggccaaaaucacauacccuuuggagcaaugguguguuagagagugacaugaucauuccaaagagucuagcugguccuaucucgcaacacaacuacaggccuggguaccacacccagacggcgggaccuuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagaugguugcugguauggcauggaaaucagacccaucaaugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagacauggcgcacacacuaauaaugauuggguccaaugcaacugacaggaugggaaugggcgucaccuaccuagcuuuaauugcaacauuuaaaauccagccauuuuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggcuggaguuucacuuuuaccagugugccagucuucgaguaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagacguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguuuuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagcccggaacuucaggaucuccuaucauaaacagagagggaaagguagugggacuguauggcaauggaguggucacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccaacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauauucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaauugccugcggaaaaacgggaaaaaggucauucaacuuaguaggaagacuuuugacacagaauaucagaaaaccaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcagcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaccaaauuuuagaagagaacauggauguggaaaucuggacaaaggaaggagaaaagaaaaaauugagaccuagguggcuugaugcucgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguaucuccaaccagcuauuuagauguggacuugcacccagcaucagccuggacauuguacgcuguggccacuacaguaauaacaccaauguugagacauaccauagagaauucuacagcaaaugugucccuggcagcuauagccaaccaagcagugguccugauggguuuggacaaaggauggccaauaucaaaaauggacuuaggaguaccccugcuggcauuggguugcuauucacaagugaacccacugacucuaacagcggcaguacucuugcugaucacacauuaugccauuauagguccaggauugcaggcaaaagccacccgugaagcucagaaaaggacagcugcuggaauaaugaagaauccaacaguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacccuagcuacaggaccaauaacaacacucugggaaggaucaccugggaaguuuuggaacaccacgauagcuguuuccauggcgaacauuuuuagagggagcuauuuagcaggagcugggcuugcuuucucuauuaugaaaucaguuggaacagggaaaagaggaacaggcucacagggugaaacuuugggagaaaaauggaaaaagaaguuaaaucaauuaucccggaaagaguuugaccuuuacaagaagucuggaaucacugaaguggauagaacagaagccaaagaaggguugaaaagaggagaaauaacacaucaugccguguccagagguagugcaaaacuucaaugguuuguggaaagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaguuuuguauuaaaguauugaacccuuacaugccagcugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggagaucacagcggaguggcucuggagaacccugggaaggaauaaaaaacccagguuaugcacaagggaagaguuuacaaaaaagguuagaacuaacgcagccaugggagcuguuuucacagaggagaaccaaugggacagcgcgaaagcugcuguugaggaugaggauuuuuggaaacuuguggacagagaacgugaacuccacaaacugggcaaguguggaagcuguguuuacaacaugauggguaagagagagaagaaacuuggagaguuuggcaaagcaaaaggcaguagagcuauaugguacaugugguugggagccagguaccuugaguucgaagcccuuggauucuuaaaugaagaccacugguucucgcgugagaauucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggauaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagacggaagaaaguuggugguucccugcagaccccaggacgaacuaauaggaagagcaagaaucucccaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucacgcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7643 - RNA, 9873 nt, Artificial Sequence
  derived and/or modified CDS sequence (wt) from DENV-3__FJ850111__SS-prME
acaucgcucugucucaugaugauauugccagcagcacuugcuuuccacuugacuucacgagauggagagccgcgcaugauuguggggaagaaugaaagaggaaaaucccuacuuuucaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgauaagagaucaguggcguuagcuccccaugucggcaugggacuggauacacgcacccaaacuuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacugcuaaugcuggucaccccauccaugacaaugagaugugugggaguaggaaacagagauuuuguggaaggacuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccaaaacuacguguguaagcauacauacguagacagaggcugggggaacggaugugguuuguuugguaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguucuugggucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacuuaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaagcaauauaguaauuggaauuggagacaacuccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucaucacacucuaucugggagcuguggugcaagcugacacgggguguguuauaaacuggaaaggcaaagaacucaaguguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguuguugugggcgauauaauuggggucuuagagcaagggaaaagaacacuaacaccacaacccauggagcuaaaauacucauggaaaacguggggaaaggcaagaauagugacagcugaaacacaaaauucuucuuucauaauagauggaccaaacacaccggaguguccaaauaccucaagagcauggaaugugugggagguggaagauuacggguucggagucuucacaaccaacauauggcugaaacuccgagagguguauacccaauuaugugaccauaggcuaaugucggcagccgucaaggaugaaagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggaccuuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaaugcaacugacaggaugggaaugggcgucaccuaccuagcuuuaauugcaacauuuaaaauccagccauuuuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggcuggaguuucacuuuuaccagugugccagucuucgaguaugaggaaaacagacuggcuuccaaugacaguggcagcuaugggaguuccaccucuaccacuuuucauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaauugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacgggggaaauaggagcaauugcacuggauuucaagcccggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccaacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauauucaugacagcaacgcccccuggaacagcugaugccuuuccccagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaauugccugcggaaaaacgggaaaaaggucauucaacuuaguaggaagacuuuugacacagaauaucagaaaaccaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcagcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcucgcaccuauucagauccccuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuauaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagagaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguugagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuacgccauuauagguccaggauugcaggcaaaagccacccgugaagcucagaaaaggacagcugcuggaauaaugaagaauccaacaguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacccuagcuacaggaccaauaacaacacucugggaaggaucaccugggaaguuuuggaacaccacgauagcuguuuccauggcgaacauuuuuagagggagcuauuuagcaggagcugggcuugcuuucucuauuaugaaaucaguuggaacagggaaaagaggaacaggcucacagggugaaacuuugggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagugcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguucuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccagcugugauugagcaccuagaaagacuacaaaggaaacauggaggaaugcuugugagaaauccacuuucacgaaacuccacgcaugaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugauacagauggcaaugacagauacaacuccauuuggccagcagagagucuuuaaagagaaaguggacaccaggacacccagguccaugccaggaacaagaaggguuauggagaucacagcggaguggcucuggagaacccugggaaggaauaaaaaacccagguuaugcacaagggaagaguuuacaaaaaaggucagaacuaacgcagccaugggagcuguuuucacagaggagaaccaaugggacagcgcgaaagcugcuguugaggaugaggauuuuuggaaacuuguggacagagaacgugaacuccacaaacugggcaaguguggaagcuguguuuacaacaugauggguaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggauaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugacugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucacgcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuauaugccuucaaugaagagauuuaggaaggaggaggaaucggagggagccauuugguaa

SEQ ID NO: 7644 - RNA, 9873 nt, Artificial Sequence
  derived and/or modified CDS sequence (wt) from DENV-3__KF955486__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugauugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuacacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaaaggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauucuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauucuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucgcgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuuuacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucgcuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7645 - RNA, 9873 nt, Artificial Sequence
  derived and/or modified CDS sequence (wt) from DENV-3__FJ898468__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauguaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagcugccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgagaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugguugagcaccuagaaagacuacaaaggaaacauggaggaaugcuugugagaaauccacuuucacgaaacuccacgcacgaaauguacuggauaucuaauggcacaggcaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucgucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacucauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7646 - RNA, 9873 nt, Artificial Sequence
  derived and/or modified CDS sequence (wt) from DENV-3__FJ898469__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacaugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacuuaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggggucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaucaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcuuacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcuggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacaccuuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucggccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7647 - RNA, 9873 nt, Artificial Sequence
  derived and/or modified CDS sequence (wt) from DENV-3__FJ898470__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacaugcaaucaagccggagagcauagacgcgauaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacuuaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggggucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagccuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaaugcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucaggcaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcuggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaagagcauaauucaacauggcacuaugaugacgaaaaccccuacaaaacgugggcuuaccauggaucuuaugaagucaaagccacaggcucggccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccagcaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7648 - RNA, 9873 nt, Artificial Sequence
  derived and/or modified CDS sequence (wt) from DENV-3__FJ898471__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaacccgaagacauugacugcuggugcaaccucacaucaacauggguaacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugauccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugcgguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugauccugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuuguaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugugauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagagaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggagucgggcuggcuauggcaacaacguuacaacugccagaggacauugaacaaauggcaaauggaaucgcucuggggcucauggcucuuaaacugauaacacaauuugaaacauaccaauuauggacagcauuagucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagccuugaaagggcucccaauaagguaccaaacaacagcaacaaaaucugaacacacaggaagagagauuguugaucugaugugccacgcaacguucacaaugcgucugcugucaccaguuaggguuccaaacuacaacuugauaauaauggaugaagcccauuucacagacccagccaguauagcugcuagaggguacauaucaacucguguugggaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgauuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagaacgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugagucuaggaagacuuucguggaacucaugaggaggggugaccuuccagucugguuagccuauaaaguagcaucagaagggaucaaauauacagauagaaaauggugcuuugauggacagcguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccggagacaauggaaacacuccuacucuugggacucaugaucuuguugacagguggagcuaugcuuuucuugauaucagguaaagggauuggaaagacuucaauaggacucauuuguguaauugcuuccagcggcauguuguggauggccgaaaucccacuccaauggaucgcgucggccauaguccuggaguuuuuuaugaugguguugcucauaccagaaccagaaaagcagagaaccccccaagacaaccaacucgcauauguugugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaaaaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacaauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcagaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuucuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauuuaccaacauggaagcccaguugaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaccuagggaagagagaagaccaauggugcggaucacuuauuggucucacuuccagggcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7649 - RNA, 9873 nt, Artificial Sequence
  derived and/or modified CDS sequence (wt) from DENV-3__FJ898472__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagcuauggacuugggagagaugugugaugacacggucacuuacaaaugcccccauauuaccgaaguggaaccugaagacauugacugcugguguaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggacauagagcuucagaagaccgaggccacccaacuggcgacccuaagaaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaagcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagccacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcccacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguagugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggugcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaguacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggaccuuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuuccucacguuuguacuccuucucucagggcaaauaacauggagagauauggcgcacacacuaauaaugauuggguccaacgcaucugacaggaugggaaugggcguuaccuaccuagcuuuaauugcaacauuuaagauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuaacuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuagauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuaucguuagagaggcaaucaagagacguuugagaacucuaauucuggcaccgacaagggugguugcagcugagauggaagaagcauugaaaggacucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauacacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcugauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaagaaccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugaugggcuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacccgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagagagacuacaaaggaaacauggaggaaugcuugugagaaauccacuuucacgaaacuccacgcacgaaauguacuggauaucuaauggcacagguaacauuguugcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcacaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauucaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucagggagcgggauggagucuuagagaaaccgcaugucugggaaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7650 - RNA, 9873 nt, Artificial Sequence
  derived and/or modified CDS sequence (wt) from DENV-3__FJ898474__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggugacuuacaaaugcccccacauuacugaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacaucccugacccagaaggugguuauuuuuauacuacuaaugcuggucaccccauccaugacaaugagaugugugggaguaggaaacagagauuuuguggaaggucuaucaggagcuacguggguugacgugguacucgagcacggggggugugugaccaccauggcuaagaacaagccaacguuggauauagagcuucagaagaccgaggccacccaauuggcgaccuuaaggaagcuaugcauugaggggaaaauuaccaacauaacaacugacucaagauguccuacccaaggggaagcggcuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaaugaaacgcagggagucacggcugagauaacaccucaggcaucgaccacugaagccaucuugccugaauauggaacccuugggcuagaaugcucaccacggacaggcuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggaacuucuugugacauucaaaaacgcacaugcgaaaaaacaagaaguaguuguccuuggaucgcaagagggagcaaugcacacugcauugacuggagccacagaaauccaaaacucaggaggcacaaguauuuuugcggggcacuuaaaaugcagacuuaagauggacaaauuggaacucaaaggaaugagcuaugcaaugugcacgaauaccuuuguguugaagaaagaagucucagaaacgcagcaugggacaauacucauuaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggagagcaauauagugauuggaauuggagacaacgccuugaaaaucaacugguauaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuuugucaccaacgagguccauaccuggacagagcaauacaaauuccaagcagacuccccaaaaagacuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgacauaauuggggucuuagagcagggaaaaagaacacuaacaccacaacccauggagcuaaaauacucauggaaaacguggggaaaggcaaaaauaaugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccauuaaggaugagagggccguacaugccgacaugggcuauuggauagaaagccaaaagaauggaaguuggaagcuagaaaaagcaucccucauagagguaaaaaccugcacauggccaaaaucacauacucuuuggaguaauggugugcuagagagugacaugaucaucccaaagggucuagcugguccuauuucgcaacacaaccacaggccuggguaucacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccgcucgugcacacuuccuccuuugcgauacauaggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauucagccauucuuggcuuugggauuuuuccuaagaaaacugacauccagagaaaauuuauuguuaggaguugggcuggcuauggcaacaacguuacaacugccagaggacauugaacaaauggcaaauggaaucgcccuggggcucauggcucuuaaacugauaacacaauuugaaacauaccaauuauggacagcauuaaucuccuuaacguguucaaauacgauuuuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaggaugaugagacugagaauauccuaacagugcuuuugaaaacagcauuacuaauaguaucaggaaucuuuccauacuccauacccgcaacauuguuggucuggcauacuuggcaaaagcaaacccaaagauccggcguucuaugggacguacccagccccccagagacacagaaagcagaacuggaagaaggggucuauaggaucaaacagcaaggaauuuuuggaaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagaccauaacaggggaaauuggagcaauugcacuggauuucaagccuggaacuucaggaucuccuaucauaaacagagagggaaagguagugggacuguaugguaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaauuauaacuugauaauaauggaugaagcccauuucacagacccagccaguauagcggcuagaggguacauaucaacucguguuggaaugggagaggcagccgcaauuuucaugacagcaacgcccccuggaacagcugaugccuuuccucagagcaacgccccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguagaaagacuuuugacacagaauaucagaaaacuaaacugaaugauugggacuucguggugacaacugacauuucagaaaugggggccaauuucaaagcugauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaggaauucaaggacuuugcggcuggcagaaagucaauugcccuugaucuugugacagaaauaggaagagugccuucacaccuagcccauagaacgagaaaugcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguucuuuaugaugguguugcuuauaccagaaccagaaaagcagagaacuccccaagacaaccaacucgcauaugucgugauaggcauacucacauuggcugcaauaauagcagccaaugaaaugggauugcuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauuccacagcaaauguguccuuggcagcuauagccaaccaggcggugguccugauggguuuggacaaaggauggccaauaucaaaaauggacuuaggaguaccccuacuggcauuggguugcuauucacaagugaacccacuaacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguccaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguaggaacagggaaaagaggaacaggcucacaaggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacaugaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaaggcccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacaugggcuuaucauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaacccugggaaggaacaaaaaacccagguugugcacaagggaagaguuuacaaagaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuacauauuaagggauauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucaggcaaauggaaggagaaggugugcugucaaaggcagaccucgagagcccucaucugccagagaagaaaauuacacaaugguuggaaaccaaaggaguggagagguuaaaaagaauggccauuagcggggaugauugcguagugaaaccaaucgaugauagguucgcuaaugcccugcucgcucugaacgauaugggaaagguucggaaagacauaccucaauggcagccaucaaagggauggcaugauuggcaacagguuccuuucugcucucaccacuuucaugaauugaucaugaaagauggaagaaaguugguaguucccugcagaccccaggacgaacuaauaggaagagcaagaauuucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaguggugcggaucacuuauuggucucacuuccagagcaaccugggcccagaacauacccacagcaauucaacaggugagaagccuuauaggcaaugaagaguuucuggacuauaugccuucaaugaagagauuuaggaaggaggaggagucggagggagccauuugguaa

SEQ ID NO: 7651 - RNA, 9873 nt, Artificial Sequence
  derived and/or modified CDS sequence (wt) from DENV-3__EU529688__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguaauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcugacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccaggauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuaucuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcccauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcacuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7652 - RNA, 9873 nt, Artificial Sequence
  derived and/or modified CDS sequence (wt) from DENV-3__EU482613__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacguacccaaaccuggaugucggcugaaggagcuuggaggcaagucgagaagguagagacaugggcccuuaggcacccaggguucaccauacuagccuuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaggcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacgucacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcccuggauuucaagccuggaacuucaggaucuccuaucauaaacagagagggaaagauagugggacuguauggcaauggagugguuacaaagaaugguggcuacgucagcggaauagcgcaaacgaaugcagaaccagauggaccgacaccagaauuggaagaagagauguucaaaaaacgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaauuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacuacacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7653 - RNA, 9873 nt, Artificial Sequence
  derived and/or modified CDS sequence (wt) from DENV-3__EU529690__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauauaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacacagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacucaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaaaggaagcucuauugggaagauguucgaggccacugcuagaggugcaaggcgcauggccaucuugggagacacagcuugggacuuuggaucagugggugguguucugaacucauuagguaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacgcugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuaacuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcaggucauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcccauagaacgagaaacgcucuggacaaucuggugaugcugcauacgucagaacauggcggcaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggauauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7654 - RNA, 9873 nt, Artificial Sequence
  derived and/or modified CDS sequence (wt) from DENV-3__EU529691__SS-prME
acaucgcucugucucaugaugauauugccagcagcacuugcuuuccacuugacuucacgagauggagagccgcgcaugauuguggggaagaaugaaagaggaaaaucccugcuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcauacaggagaucaacaccaggugggaaaugaaacgcagggagucacggcugagauaacaccucaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccacagaaauccaaaacucaggaggcacaaguauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaguggcagacugauuacagccaacccaguggugacuaagaaggaggagccugucaauauugaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgguaggaaucaucacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaacuagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagggacauggcgcacacacuaauaaugauuggguccaacgcaucugacaggaugggaaugggcgucaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagccaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacgucacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggggaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaacgaugaagaccaugcucacuggacagaagcaaaaaugcugcuggacaacauuaauacaccagaagggaucauaccagcucucuuugagccagaaagggagaagucagccgccauagauggugaguaucgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcccgcacuuauucagaucccuuagcacucaaagaauucaaggacuuugcggcuggcagaaagucaaucgcccuugaucuugugacagaaauaggaagagugccuucacaccuagcccauagaacgagaaaugcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagaccucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggauuguuggaaacuacaaagagagauuuaggaaugucuaaggagccagguguuguuucuccaaccagcuauuuagauguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuucucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaaccauaagaguuuugaagaugguugaaccauggcuaaagaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacgcacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaacggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaagggucauggggaucacagcggaguggcucuggagaaccuugggaaggaacaaaaaacccagguuaugcacaagggaagaguuuacaaaaaaggucagaacuaacgcagccaugggugccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagccauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7655 - RNA, 9873 nt, Artificial Sequence
  derived and/or modified CDS sequence (wt) from DENV-3__EU569689__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcguauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaagcguggggaaaggcaaaaauagugacagcugaaacacaaaauucuucuuucauaauagauggaccaaacacaccggaguguccaagugccucaagagcauggaaugugugggagguggaagauuauggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauuuggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaacuaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuccauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaacuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaagcaaaagccacucgugaagcucaaaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacucucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcauuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgccaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaauaucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7656 - RNA, 9873 nt, Artificial Sequence
  derived and/or modified CDS sequence (wt) from DENV-3__EU482614__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcugugguacaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaacaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacacacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauccuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacucaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcguuugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuacuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaaugcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaucucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7657 - RNA, 9873 nt, Artificial Sequence
  derived and/or modified CDS sequence (wt) from DENV-3__EU569690__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaaguuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggagcaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggaugaacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaauaccacaacccauggagcuaaaauacucauggaaaacguggggaaaggcaaaaauagugacagcugaaacacaaaauucuucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacucugauuuuggccggaguuucgcuuuuaccagugugccagucuucgagcaugaggaaaacagacuggcuuccaaugacaguggcagcuaugggaguuccaccucuaccacuuuuuauuuuuagcuuaaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguuuuaugggauguacccagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacuuuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaacacaccagaagggaucauaccagcucuuuuugagccagaaagggagaagucagccgccauagacggugaguaucgucugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugacgcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcacgcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggaguaccccugcuggcauuggguugcuauucacaagugaacccacugacucuaacggcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucuguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7658 - RNA, 9873 nt, Artificial Sequence
  derived and/or modified CDS sequence (wt) from DENV-3__EU569691__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaacuaacaugugcacacucauagccauggacuugggagagaugugugaugacacggucacuuacaaaugcccccauauuaccgaaguggaaccugaagacauugacugcuggugcaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggcuaagaacaagcccacguuggauauagagcuucagaagaccgaggccacccaacuggcgacccuaaggaagcuaugcauugagggaaaaaucaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaguacaccgucaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaaaaaacaagaaguaguuguccuuggaucgcaagagggagcaaugcauaccgcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgaguacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccaccgcuagaggugcaaggcgcauggccaucuugggagacacagcuugggacuuuggaucagugggugguguuuugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacaugggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagauggaccaaacacaccggaguguccaagugccucaagagcauggaaugugugggagguggaagauuacggguucggagucuucacaaccaacauauggcugaaacuccgagagguguauacccaacuaugugaccauaggcuaaugucggcagccgucaaggaugagagggccguacaugccgacaugggcuauuggauagaaagccaaaagaauggaaguuggaaacuagaaaaagcaucccucauagaggugaaaaccugcacauggccaaaaucacauacccuuuggaguaauggaguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagauauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaauuuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuaccuugaaagacacacucaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacaggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauacccgcaacauuguuggucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcuacuggacaacaucaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacgcaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuacacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggccauaguccuggaguuuuuuaugaugguguugcuuauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguccugauggguuuagacaaaggauggccaauaucaaaaauggacuuaggaguaccccugcuggcauuggguugcuauucacaagugaacccacugacucuaacagcggcaguacucuugcugaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacagggaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacagaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaaacccagguuaugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuucuaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugccuugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggacgagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7659 - RNA, 9873 nt, Artificial Sequence
  derived and/or modified CDS sequence (wt) from DENV-3__EU482452__SS-prME
acaucgcucugccucaugaugauguuaccagcaacacuugcuuuccacuugacuucacgcgauggagagccgcgcaugauuguggggaagaaugaaagagggaaauccuuacuuuucaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggccgaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccaccauggcuaagaacaagccuacgcuggacauagagcuucagaagaccgaggccacccaacuggcaacccuaaggaaguuaugcauugaagggaaaauuaccaacauaacaacugacucaagguguccuacccaaggggaagcgauucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcagugguucuuugaccuaccccuaccauggacaucaggagcuacaacagagacaccaacuuggaacaggaaagagcuucuugugacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuuagauaccuuuguguugaagaaagaagucucugaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaacucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaccuauuguggaagcaaauagccaaugagcugaacuacauauuaugggaaaacaacaucaaauuaacgguaguugugggugacguaauuggggucuuagagcaagggaaaagaacacuaacaccacagcccauggagcuaaaauauucauggaaaacauggggaaaggcaaaaauagugacagcugaaacacaaaauuccucuuucauaauagaugggcuaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuggagagugacaugaucaucccaaagagucuagcugguccuauuucacaacauaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacagaaugggaaugggcguuaccuacuuagcuuuaauugcaacauucaaaauccagccauucuuggcuuugggauucuuccugaggaaguugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacauguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuucacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaaucuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcggcugagauggaagaagcacugaaaggacucccaauaagguaucaaacaacugcaacaaaaucugaacacacaggaagggagauuguugaucuaaugugccacgcaacauucacaaugcgcuuguuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagccggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugaugaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauauacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaccuugugacagaaauaggaagagugccuucacacuuagccuacagaacgagaaacgcccuggacaacuuggugaugcugcacacaucagaacauggcgguagggcuuacaggcaugcaguggaggaacuaccagaaacaauggaaacacuccuacucuugggacucaugaucuuauuaacagguggagcaaugcuuuucuugauaucaggcaaagggauuggaaagacuucaauaggacucauuuguguuauuguuuccaguggcaugcuauggauggcugauaucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagagacaacacaucaugccguguccagaggcagcgcaaaacuucaaugguucguggagaggaacauggucauucccgaaggaagggucauagacuuaggcuguggaagaggaggcuggucauauuacugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugaaaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauacggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaacccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuuuacagaggagaaccaaugggauagcgcgagagcugcuguugaagacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaucacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaggaaacugcaugucuagggaaagccuacgcucaaauguggagucucauguauuuccacagaagagaucuuagacuagcauccaacgccauuuguucagcaguaccaguccauuggaucccuacaagcagaacgacauggucuauucacgcucaccaucaguggaugacuacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagucuuauaggcgaugaagaauuucuggacuacaugccuucgaugaagagauucaggaaggaggaggagucagagggagccauuugguaa

SEQ ID NO: 7660 - RNA, 9873 nt, Artificial Sequence
  derived and/or modified CDS sequence (wt) from DENV-3__EU482453__SS-prME
acaucgcucugccucauaaugauguuaccagcaacacuugcuuuccaccugacuucacgcgauggagagccgcgcaugauuguggggaagaaugaaagagggaaauccuuacuuuuuaagacagcuuccggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagcuaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugcgauaggaauuaucacacucuaucugggagcugugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgggagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaccaaugagaaagaagagaacaugguaaagucuuuagucucagcagggaguggaaagguggacaacuucacaaugggaguccuguguuuggcaauucucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgcuacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggagcaguacugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcauugaagggacucccaauaagguaucaaacaacugcaacaaaaucugaacacacaggaagggagauuguugaucuaaugugccaugcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcuguuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuucgauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuugggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggaguuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagugcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugagaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauucacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggacagcgcaagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccucauaggcgaugaagaauuucuggacuacaugccuucgaugaagagauucaggaaggaggaggaguuagagggagccauuugguaa

SEQ ID NO: 7661 - RNA, 9873 nt, Artificial Sequence
  derived and/or modified CDS sequence (wt) from DENV-3__EU482454__SS-prME
acgucacucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagcuauggacuugggagaaaugugugaugacacggucacuuauaaaugcccccucauugccgaaguggaaccugaagacauugacugcuggugcaaccucacaucgacaugggugacuuauggaacgugcaaucaagcuggggagcauagacgcgacaagagaucaguggcguuagcuccccaugucggcaugggacuggauacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuucauacuacuaaugcuggucacuccauccaugacaaugagaugcgugggaguaggaaacagagauuuuguggaaggucugucaggagcaacguggguugauguggugcuugagcacggugggugugugaccaccauggcuaagaacaagccuacgcuggacauagagcuucagaagaccgaggccacucaacuggcgacccuaaggaaguuaugcauugagggaaaaauuaccaacauaacaacugacucaagguguccuacccagggggaagcgacuuuaccugaggagcaggaccagaacuacguauguaagcacacauacguugauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagccacaacagagacaccaacuuggaacaggaaagagcuucuuguaacauucaaaaaugcacaugcaaaaaagcaagaagugguuguccuuggaucgcaagagggagcaaugcacacagcgcugacaggagcuacugagauccaaaacucaggaggaacaagcaucuuugcggggcacuugaaauguagacuuaagauggacaaauuggaacucaaggggaugagcuaugcaaugugcuugaauaccuuugugcugaagaaagaagucuccgaaacgcagcaugggacaauacucaucaagguugaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccaaaggugcaaggcgcauggccaucuuaggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggauugaauucaaaaaacacuuccaugucauuuucaugcauugugauaggaauuauuacacucuaccugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggagcuugggaaaauggaguuuguggaaucaggucaacaaccagaauggaaaaucuauuguggaagcaaauagcuaaugagcuaaacuacauauuaugggaaaacaacaucaaauuaacaguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcacgccgacaugggcuauuggauagaaagccaaaagaauggaaguuggaagcuagaaaaagcauccuucauagagguaaaaaccuguacuuggccaaaaucacacacucuuuggagcaaugguguacuagagagugacaugaucaucccaaagaguuuagcugguccuauuucacaacacaaccacaggcccggguaccacacccaaacggcaggaccuuggcacuugggaaaacuggagcuggauuucaacuauugugaaggaacaacaguagucaucacagaaaacugugggacaagaggcccaucauugagaacaacaacagugucagggaagcugauacaugaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguucuauguuuggcaauccucuucgaagaggugaugagaggaaaauuugggaagaaacacaugauugcagggguucucuuuacauuugugcuccuucucucagggcaaauaacauggagagauauggcacacacacucauaaugauuggguccaacgcuucugacaggauggggaugggcguuaccuacuuagcuuuaauugcaacauucaaaauccagccauucuuggcuuugggauucuuccugaggaaauugacaucuagagaaaauuugcuguugggaguuggguuggccauggcaacaacguugcaacugccagaggacauugaacaaauggcgaauggaauugcccuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacauggguggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacugcuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagagagaaggagucuuccacacuauguggcacgucacaagaggggcaguauugacgcacaaugggaaaagacuggaaccaaacugggccagcgugaaaaaagaucugauuucauacggaggaggauggagauugagcgcgcaauggcaaaagggagaggaggugcagguuauugccguagagccugggaaaaaccccaaaaacuuucaaaccaugccgggcacuuuucagacaacaacgggggaaauaggagcaauugcacuagacuucaagccuggaacuucaggaucuccuaucauaaacagagagggaaaaguagugggacuguauggcaauggaguggucacaaaaaauggugguuacgucaguggaauagcgcaaacaaaugcagaaccagauggaccgacaccggaauuggaagaagaaauguucaaaaagcgaaauuuaaccauaauggaucuucacccugggucagggaagacgcggaaauaucuuccagccauugucagagaagcaauuaagagacgcuuaagaacucuaauuuuggcaccaacaagagugguugcagcugagauggaagaagcacugaaaggacuuccaauaagguaucaaacaacugcaacaaaaucugaacacacaggaagggagauuguugaucuaaugugccacgcaacauucacaaugcgcuuguuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaacucgggcaaugaauggauuaccgacuuuguugggaagacggugugguuugucccuagcaucaaagccggaaaugacauagcaaacugccugcggaaaaaugggaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggaccugagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcuguuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaccaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugcccucacacuuagcccacagaacgagaaacgcccuggacaauuuggugaugcugcacaagucagaacauggcgguagggccuacaggcaugcaguggaggaacuaccagaaacaauggaaacacuccuacucuugggacucaugaucuuauuaacagguggagcaaugcuuuuccugauaucaggcaaagggauuggaaagacuucaaugggacucauuuguguuauuguuuccagcggcauguuauggauggcugaugucccacuucaauggaucgcgucggcuauagucuuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaacuagcuauuuagauguagacuugcacccagcaucagccuggacgcuguacgccguggccacaacaguaauaacaccaauguugagacauaccauagagaauuccacagcaaaugugucccuggcagccauagcuaaccaggcagugguccugauggguuuagacaaaggauggccuauaucgaaaauggaccuaggcguaccgcuacuggcacugggcugcuauucacaagugaacccacugacucucacagcagcaguacuucugcuaguuacacauuaugccauuauagguccaggacugcaggcaaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccugggaaguuuuggaacaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuccaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaaaaugguugagccauggcuaaaaaacaaccaguuuugcauuaaaguauuaaacccuuacaugccaacugugauugagcaccuagaaagacuacaaagaaaauauggaggaaugcuuguaagaaacccacucucacgaaacucuacgcaugaaauguacuggauauccaaugguaccggcaacaucgucucuucagucaacaugguauccagauugcuacugaacagauucacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugagcuccacaaauuggguaaguguggaagcugcgucuacaacaugaugggcaagagagagaagaaacuuggagaguuuggcaaagcaaaaggcaguagagcuauaugguacaugugguugggagccagguaccucgaguucgaagcacucggauuuuuaaaugaagaccacugguucucacgugaaaacucuuacaguggaguagaaggagaaggacugcacaagcugggauauauuuuaagggacauuucuaagauacccggaggagccauguaugcugaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucuguuagagaagagaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacugauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccagcccauuggaucccuacgagcagaacgacauggucuauccacgcucaccaucaguggaugacuacagaagacaugcuuacugucuggaacaggguguggauagaggacaauccauggauggaagacaaaacuccagucacaacuugggaagauguuccauaccuagggaaaagagaagaucaauggugcggaucacucauuggucucacuuccagagcaaccugggcccagaacauacucacagcaauccaacaggugagaagccucauaggcgaugaagaauuucuggacuacaugccuucgaugaagagauucaggaaggaggaggagucagagggagccauuugguaa

SEQ ID NO: 7662 - RNA, 9873 nt, Artificial Sequence
  derived and/or modified CDS sequence (wt) from DENV-3__EU482455__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuacaaaugcccccucguugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccaaggggaagcgauucuaccugaagagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaagaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaaucaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccgaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaacugacaucuagagaaaauuuguuguugggaguuggguuggccauggcaacaacguuacaacugccagaggacauugaacaaauggcgaauggaauugcucuggggcucaugacucuaaaacugauaacacaauuugagacauaucaauuguggacagcauuagucuccuuaacguguucaaacacaauuuucacucugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagauggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaauaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaauugagaccuagguggcuugaugcccgcacuuauucagaucccuuagcacuuaaggaauucaaggauuuugcagcuggcagaaagucaaucgccuuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccagugguauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuagcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuggcaggagcugggcuugcuuuuucuaucaugaaaucaguuggaauaggaaggagaggaacggggucacaaggcgaaaccuugggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuagguuguggaagaggaggcuggucauauuauugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugagaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaauauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcagugccaguccauuggaucccuacaagcagaacgacauggucuauucacgcucaccaucaguggaugaccacagaagacaugcuaacugucuggaacaggguguggauagaggacaauccauggauggaagacaaaacuccaguuacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7663 - RNA, 9873 nt, Artificial Sequence
  derived and/or modified CDS sequence (wt) from DENV-3__EU482456__SS-prME
acaucgcucugccucaugaugauguuaccagcaacacuugcuuuccacuugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucagcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccaaggggaagcgauucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacuguuaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucacugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcgaaaaagcaagaagugguuguccuuggaucgcaagagggagcaaugcacacagcgcugacaggagccacagagauucaaaacucaggagguacaagcaucuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuagcggagucucauggauaaugaaaauuggaauagguguccucuuaaccuggauaggguugaauucaaaaaauacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacacaauuggggucuuagagcaagggaaaagaacauuaacaccacagccuauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaaacuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuauguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaaugcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaccaguuguggacggcauuagucuccuuaacauguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccgcuguuuaucuucagcuugaaggacacaccaaaaaggaggagcuggccacugaaugagggagugauggcuguugggcuugugagcauucuagcuagcucucuccuuaggaaugaugugcccauggcuggaccacuaguggccgggggcuuguugauagcgugcuaugucauaacuggcacgucagcagaccucacuguagaaaaggcagcagacguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauauggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagaguaacgcuccaauucaagaugaagaaagggauauuccggaacgcucauggaauucagguaaugaauggauuaccgacuuuguuggaaagacggugugguuuguaccuagcaucaaagccggaaaugacauagcaaacugccugcggaaaaaugggaaaaaggucauccaacuuaguagaaagacuuuugauacagaauaucaaaagaccagacugaaugacugggacuucguggugacaacagacauuucagaaaugggagcuaacuuuaaagcagauagagugauugacccaagaagaugucucaagccaguaauuuugacagauggacccgagcgagugauccuggcuggaccaaugccugucaccgcagcgagcgcugcgcaaaggagagggagaguuggcaggaacccacaaaaggaaaaugaccaguacauauucacgggccagccucucaacaaugacgaagaccaugcucacuggacagaagcaaaaauguugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauucuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauauguguuauuguuuccaguggcauguuauggauggcugaugucccacuccaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaaccacaaagagagacuuaggaaugucuaaagaaccagguguuguuucuccaaccagcuauuuagauguagacuugcacccagcaucagccuggacauuguaugccguggccacaacaguaauaacaccaauguugagacauaccauagagaauuccacagcaaauguaucccuggcagccauagcuaaccaggcagugguccugauggguuuagacaaaggauggccaauaucgaaaauggaccuaggcguaccgcuauuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggacagaacagaagccaaagaaggguugaaaagaggagaaacaacacaucaugccguguccagaggcagcgcaaaacuucaaugguucguggagaggaacauggucauucccgaaggaagagucauagaccuaggcuguggaagaggaggcuggucauauuacugugcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugaaaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguacuggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaaucccuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucaccaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuauaauaugaugggcaagagagagaagaaacuuggagaguuugguaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcuuacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuagucagacagauggaaggagaaggcguguugucgaaggcagaccucgagaauccucaucugcuagagaagaaaaucacacaaugguuggaaaccaaaggaguggagagauuaaaaagaauggccaucagcggagaugauugcguggugaaaccgauugaugacagguuugccaacgcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuaacugucuggaacaggguguggauagaggauaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugaggagccuuauaggcgaugaagaauuucuggacuacaugccuucaaugaagagauucaggaaggaggaggagucagagggagccauuugguaa

SEQ ID NO: 7664 - RNA, 9873 nt, Artificial Sequence
  derived and/or modified CDS sequence (wt) from DENV-3__EU482457__SS-prME
acaucguucugucucaugaugauguuaccagcaacacuugccuuccacuugacuucacgcgauggagagccgcgcaugauaguggggaagaaugaaagagggaaaucccuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuauggaacgugcaaucaagcuggggagcauagacgcgacaagagaucaguggcguuagcuccccaugucggcaugggacuggacacacguacccaaaccuggaugucggcugaaggagcuuggagacaaguugaaaagguagagacaugggcucuuaggcacccagguuuuaccauacuagcucuauuucuagcccauuacauaggcacuucccugacccagaaagugguuauuuuuauacuacuaaugcuggucacuccauccaugacaaugagaugcguggggguaggaaacagagauuuuguggaaggucugucaggagcuacguggguugacguggugcucgagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaaggugucccacccagggggaagcgacuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaggugggaaaugacacgcagggagucacgguugagauaacaccccaggcaucaaccguugaagcugucuugccugaguauggaauccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagccacagagauucaaaacucaggagguacaagcauuuuugcggggcacuugaaauguagacuuaagauggacagauuggaacucaaggggaugagcuaugcaauguguuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagauugaucacagccaacccaguggugaccaagaaggaggagccugucaacaucgaggcugaaccuccuuuuggggaaagcaacauagugauuggaauuggagacaaagccuugaaaauuaauugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucagaucaacaaccagaauggagaaucuauuguggaagcaaauagccaaugagcugaacuacauauuaugggaaaacaacaucaaauuaacgguaguugugggcgacacaauuggggucuuagagcaagggaaaagaacacuaacaccacaacccauggagcuaaaauauucauggaaaacauggggaaaggcaaaaauagugacagcugaaacacaaaauuccucuuucauaauagaugguccaaacacaccggaguguccaagcgccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaaguuagaaaaagcauccuuuauagaggugaaaaccuguacuuggccaaaaucacauacucuuuggagcaaugguguacuagagagugacaugaucaucccaaagaguuuagcugguccuaucucacaacacaaccacaggccuggguaccacacccaaacggcaggaccuuggcacuugggaaaauuggagcuggacuucaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacauacccucauaaugauugggucuaacgcuuccgacaggauggggaugggcguuaccuacuuggcuuuaauugcuacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaauacaauuuucacguugacuguugccuggagaacagccaccuugauucuggccggaguuucgcuuuugccacugugccagucuucgagcaugaggaaaacagauuggcucccaaugaccguggcagcuaugggaguuccacccuuaccacuuuuuaucuucagcuugaaggacacacccaaaaggaggagcuggccacugaaugagggagugauggcuguugggcuugugagcauucuggcuaguucucuccucaggaaugaugugcccauggcuggaccacuaguggccgggggcuuguugauagcgugcuaugucauaacuggcacgucagcugaccucacuguagaaaaagcagcagauguaacaugggaggaagaggcugagcaaacaggagugucccacaauuugauggucacaguugaugaugauggaacaaugagaauaaaggaugaugagacugagaacauccuaacagugcucuuaaaaacagcacuacuaauaguaucaggcaucuuuccauacuccauacccgccacacuguuggucuggcauacuuggcaaaagcaaacccaaagaucuggcguucuaugggacguacccagccccccagaaacacagaaagcagaauuggaagagggggucuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccagaauuggaagaagaaauguucaaaaagcgaaaucuaaccauaauggaucuucauccugggucaggaaagacgcggaaauaucuuccagccaucguuagagaagcaaucaagagacgcuuaagaacucuaaucuuggcaccaacaagagugguugcagcugagauggaagaagcacugaaaggacucccaauaagguaccaaacaacugcaacaaaaucugaacacacaggaagggaaauuguugaucuaaugugccacgcaacauucacaaugcgcuugcuaucaccagucaggguuccaaauuacaauuugauaauaauggaugaggcccauuucacagauccagccaguauagcggcuagaggguauauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccacgcucacuggacagaagcaaaaaugcugcuagacaacaucaacacaccagaagggaucauaccagcucucuuuggaccagagagggagaagucagccgcuauagacggugaauaccgccugaagggugaguccaggaagaccuucguggaacucaugaggaggggugaccucccaguuuggcuagccuauaaaguagccucagaagggaucaaauacacagauaggaaauggugcuuugauggagaacguaacaaucaaauuuuagaggagaacauggauguggaaaucuggacaaaggaaggagaaaggaaaaaauugagaccuagguggcuugaugcccgcacuuauucagaucccuuagcacucaaggaauuuaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucaggcaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucucuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccaucauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagccguuuccauggcuaacaucuuuagagggagcuaccuagcuggagcugggcuugcuuuuucuaucaugaaaucaguuggaacaggaaggagaggaacggggucacaaggcgaaaccuuaggagaaaaguggaaaaagaaacuaaaucaguuaucccggaaagaguuugaccuuuacaagaaaucuggaaucacugaaguggacagaacagaagccaaagaaggguugaaaagaggagaaacaacacaucaugccguguccagaggcagcgcaaaacuucaaugguucguggagaggaacauggucauucccgaaggaagagucauagacuugggcuguggaagaggaggcuggucauauuacugcgcaggacugaaaaaaguuacagaagugcgaggauacacaaaaggcggcccaggacacgaagaaccaguacccaugucuacauacggauggaacauagucaagcuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaaaaaacaaccaguuuuguauuaaaguauuaaaccccuacaugccaacugugauugagcaccuagaaagacuacaaagaaaauauggaggaaugcuugugagaaacccacucucacgaaacuccacgcaugaaauguacuggauauccaauggcaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaaguuaaagccacaggcucagccuccuccaugauaaauggagucgugaaacuccucacaaagccaugggaugugguucccauggugacacagauggcaaugacagauacaacuccauuuggacagcaaagaguuuucaaggagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggaaaaccaaugggauaaugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugcugaugacacagcugguugggacacaagaauaacagaagaugaccugcacaaugaggaaaaaaucacacagcaaauggacccugaacacagacaauuggcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaggucccuuuuugcucccaccacuuucaugagcugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaucuaggaaagagagaagaucaauggugcggaucacucauuggucucacuuccagagcaaccugggcccagaacauacucacagcaauccaacaggugagaagccuuauaggugaugaagaauuucuggacuacaugccuucgaugaagagauucaggaaggaggaggagucagagggagccauuugguaa

SEQ ID NO: 7665 - RNA, 9873 nt, Artificial Sequence
  derived and/or modified CDS sequence (wt) from DENV-3__EU482458__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuuuaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuacaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccauaggccuggguaccacacccaaacggcaggaccuuggcacuugggaaaauuggagcuggacuuuaacuauugugaaggaacaacaguagucaucacagaaaacugugggaugagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaauuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccaaagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaauggaaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaaaggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagccggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaaccccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuacgccauuauagguccaggauugcaggcuaaagccacucgugaagcucaaaaaagaacagcugcuggaauaaugaagaauccaacgguagaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuggcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugagaagugugacacccuauugugugacauuggagaaucuucaccaagcccaacaguggaagaaagcagaacuauaagagucuugaagaugguugagccauggcuaaaaaauaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaauauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcagcggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccaaucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7666 - RNA, 9873 nt, Artificial Sequence
  derived and/or modified CDS sequence (wt) from DENV-3__EU482459__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuccuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccgacgcuggacauagagcuucagaagaccgaggccacccaacuggcgacccuaaggaaguuaugcauugagggaaaaauuaccaacauaacaacugauucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcuaacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaauacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaagguguguugucgaaggcagaccucgagaacccucaucugcuagagaagaaaaucacacaaugguuggaaaccaaaggaguggagagguuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7667 - RNA, 9873 nt, Artificial Sequence
  derived and/or modified CDS sequence (wt) from DENV-3__EU482460__SS-prME
acaucgcucugccucaugaugauguuaccagcaacauuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuacaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagcuuggaugguacauaggcaaugguucuuugaccuaccccuaccauggacaucaggaacuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcaccugaaauguagacuuaagauggacaaauuggaacucaaggggaugagcuaugcaaugugcuugaacaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacagauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagagcauuagcaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggagucggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuauguuauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcacacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcauaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaaugggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggaccugagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauccaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugagaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucggucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggauuaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaaccccauuugggcagcaaagaguuuucaaagagaaaguggacaccaggacacccaggcccaugccagggacaagaaagguuauggagaucacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacucggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuagaaaccaaaggaguggagagauugaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7668 - RNA, 9873 nt, Artificial Sequence
  derived and/or modified CDS sequence (wt) from DENV-3__EU482461__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuccuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagugcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugguaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacuguaauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7669 - RNA, 9873 nt, Artificial Sequence
  derived and/or modified CDS sequence (wt) from DENV-3__EU482462__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaggaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucauuaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacggaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacacugacaccacagcccauggaccuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggaaagauauggcacacacauucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaauuguggacagcauuagucuccuuaacguguucaaacacaauuuucacgcugacuguugccuggagaacagccaccuugguucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauaccugccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuauuauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucacccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccagcauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaagguuauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacgcaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaacuagcuauuuggauguagacuugcacccagcaucagccuggacacuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuggcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaccaugccguguccagaggcagcgcaaaacuucaaugguucguggagaggaacauggucauucccgaaggaagagucauagauuuaggcuguggaagaggaggcuggucauauuacugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugagaagugugacaccuuauugugugacauuggagaaucuucaccaagcccaacaguggaagaaagcagaacuauaagagucuugaagaugguugagccauggcugaaaaacaaccaguuuuguauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaggccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauuaggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacagcggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcacgauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggauccccauaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccaucugguaa

SEQ ID NO: 7670 - RNA, 9873 nt, Artificial Sequence
  derived and/or modified CDS sequence (wt) from DENV-3__EU660407__SS-prME
acaucgcucugccucaugaugauguuaccagcaacacuugcuuuccacuugacuucacgcgauggagagccgcgcaugaucguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacucagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcauacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggauaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcguauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagaaugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaaugcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacauguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagugugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccaacaccggaauuggaagaagaaauguucaaaaagcgaaauuuaaccauaauggaucuucauccugggucaggaaagacgcggaaauaucuuccagccaucguuagagaagcaaucaagagacguuugagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagccggaaaugacauagcaaacugccugcggaaaaauggaaaaaaggucauccaacuuaguagaaagacuuuugauacagaauaucaaaagaccaaacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucuauuugaaccagagagggagaagucagccgcuauagacggugaauaccgccugaagggugaguccaggaagaccuucguggaacucaugaggaggggagaccucccaguuuggcuagcccacaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccaggcguuguuucuccaaccagcuauuuagauguagacuugcacccagcaucagccuggacauuguacgccguggccacaacaguaauaacaccaauguugagacauaccauagagaauuccacagcaaauguaucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaagaguuacagaagugcgaggauacacaaaagguggcccaggacacgaagaaccaguacccauguccacauacggauggaauauagucaagcuaaugaguggaaaggacguguuuuaucuuccaccugaaaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguacuggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguacaacgaccaacuccaaaaggcacgguaauggacaucauaucuagaaaagaccaaagaggcaguggacagguggggacuuauggucugaacacauucaccaacauggaagcccaguuagucagacagauggaaggagaaggcguguugucgaaggcagaccucgagaacccccaucugcuagagaagaaaaucacacaaugguuggaaaccaaaggaguggagagauuaaaaagaauggccaucagcggagaugauugcguggugaaaccgauugaugacagguucgccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguccccugcagaccccaggacgaacuaauaggaagggcgagaauuucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7671 - RNA, 9873 nt, Artificial Sequence
  derived and/or modified CDS sequence (wt) from DENV-3__EU660409__SS-prME
acaucgcucugccucaugaugauguuaccagcaacacuugcuuuccacuugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuagucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccgacuggcgacccuaaggaaguuaugcauugagggaaaaauuaccaacauaacaacugacucaaggugucccacccagggggaagcgauucuaccugaggagcaggaccagaacuacguauguaagcacacauacguggauagagguuggggaaacgguuguggcuuguuuggaaaaggaagcuuggugacaugcgcgaaauuucaaugucuagaacuaauagagggaaaaguggugcaauaugagaaccuuaaauacacugucaucaucacagugcacacaggagaccaacaccaagugggaaaugacacgcagggagccacgguugagauaacaccccaggcaucaaccguugaagccgucuugccugaguauggaacccuugggcuagaaugcucgccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuugugacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggauaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugcgauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcuaaacuacauauuaugggaaaacaacaucaaauuaacgguaguugugggugacauaauuggggucuuagagcaagggaaaagaacgcuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggcugugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaaggggcccaucauugagaacaacaacagugucagggaagcugauacacgaaugguguugccgcucgugcacacuuccucccuuacgauacaugggagaggacggcugcugguaugguauggaaauuagaccuaucaaugagaaagaagagaacaugguaaagucuuuagucucagcagggaguggaaagguggacaacuucacaaugggagcccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacagaaugggaaugggcguuaccuacuuagcuuuaauugcaacauucaaaauccagccauucuuggcuuugggauucuuccugaggaaauugacauccagagaaaauuugcuguugggaguuggguuggccauggcaacaacguuacaacugccagaggacauugaacagauggcgaauggaauugcucuggggcucaugacucuaaaacugauaacacaauuugagacauaucaguuguggacagcauuagucuccuuaacauguucaaacacaauuuucacgcugacuguugccuggagaacagccaccuugauucuggccggaguuucgcuuuugccacugugccagucuucgagcaugaggaaaacagauuggcucccaauggcuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaagguagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaaucuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagccggaaaugacauagcaaacugccugcggaaaaaugggaaaaaggucauccaacuuaguagaaagacauuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagcuuacagaacgagaaacgcccuggacaacuuggugauguugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuacuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaacauagucaagcuaaugaguggaaaggacgucuuuuaucuuccaccugaaaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcguuuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguccaacgaccaacuccaaaaggcacgguaauggacaucauaucuagaaaagaccaaagaggcaguggacagguggggacuuauggucugaacacauucaccaacauggaagcccaguuagucagacagauggaaggagaaggcguguugucgaaggcagaccucgagaacccucaucuguuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaaggaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagucuuauaggcgaugaagaauuucuggacuacaugccuucgaugaagagauucaggaaggaggaggagucagagggagccauuugguaa

SEQ ID NO: 7672 - RNA, 9873 nt, Artificial Sequence
  derived and/or modified CDS sequence (wt) from DENV-3__EU660410__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaggaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucauuaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacggaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagacuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuauuaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacauucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaauuguggacagcauuagucuccuuaacguguucaaacacaauuuucacgcugacuguugccuggagaacagccacuuugguucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauaccugccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuauuauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucacccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccagcauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaagguuauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacgcaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaacuagcuauuuagauguagacuugcacccagcaucagccuggacacuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcgcaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuggcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaccaugccguguccagaggcagcgcaaaacuucaaugguucguggagaggaacauggucauucccgaaggaagagucauagauuuaggcuguggaagaggaggcuggucauauuacugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugagaagugugacaccuuauugugugacauuggagaaucuucaccaagcccaacaguggaagaaagcagaacuauaagagucuugaagaugguugagccauggcugaaaaacaaccaguuuuguauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaggccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccaggaacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauuaggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcacgauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggauccccauaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccaucugguaa

SEQ ID NO: 7673 - RNA, 9873 nt, Artificial Sequence
  derived and/or modified CDS sequence (wt) from DENV-3__EU660411__SS-prME
acaucgcucugccucaugaugauguuaccagcaacacuugcuuuccacuugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacgcacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaaaaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcauacaggagaccaacaccaagugggaaaugacacgcagggagucacgguugagauaacaccccaggcaucaaccguugaagccgucuugccugaguauggaacccuugggcuagaaugcucaccacggacaggcuuggauuucaacgaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcaucuuugcggggcacuugaaauguagacuuaagauggauaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacacuaacaccacagcccauggagcuaaaauauucauggaaaacauggggaaaggcaaaaauagugacagcugaaacacaaaauuccucuuuuauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucauuacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacuuaucaguuguggacagcauuagucuccuuaacauguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauccuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuacaggaucaaacaacaaggaauuuuuggaaaaacccaaguggggguuggagugcagaaagaaggagucuuccacaccauguggcacgucacaagaggggcaguauugacgcacaaugggaaaagacuggaaccaaacugggccagugugaaaaaagaucugauuucauacggaggaggauggagauugagugcacaauggcaaaaaggagaggaggugcagguuauugcuguggagccugggaagaacccaaaaaacuuccaaaccaugccgggcauuuuucagacaacaacgggggaaauaggagcaauugcacuagacuucaagccuggaacuucaggaucuccuaucauaaacagagagggaaagauagugggacuguauggcaauggagugguuacgaaaaaugguggcuacgucaguggaauagcgcaaacaaaugcagaaccagacggaccgacaccggaauuggaagaggaaauguucaaaaagcgaaaucuaaccauaauggaucuucauccugggucaggaaagacgcggaaauaucuuccagccaucgucagagaagcaaucaagagacguuugagaacucuaauuuuggcaccaacaagagugguugcagcugagauggaagaagcacugaaaggacucccaauaagguaucaaacaacugcaauaaaaucugaacacacaggaagggagauuguugaucuaaugugccacgcaacauucacaaugcgcuugcuaucaccagucaggguuccaaauuacaauuugauaauaauggaugaggcccacuucacagauccagccaguauagcggcuagaggguacauaucaacucguguaggaaugggagaggcagcugcaaucuucaugacagcaacacccccuggaacugcugaagccuuuccucagagcaacgcuccaauucaagaugaagaaagggauauuccggaacgcucauggaauucaggcaaugaauggauuaccgacuuuguuggaaagacggugugguuuguaccuagcaucaaagccggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagcuaacuuuaaagcagauagagugauugacccaagacgaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucuauuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccaggcguuguuucuccaaccagcuauuuagauguagacuugcacccagcaucagccuggacauuguacgccguggccacaacaguaauaacaccaauguugagacauaccauagagaauuccacagcgaauguaucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacuguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuauuaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugcuguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaauauagucaaacuaaugaguggaaaggacguguuuuaucuuccaccugaaaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguacuggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcaagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuagucagacagauggaaggagaaggcguguugucgaaggcagaccucgagaacccccaucuacuagagaagaaaaucacacaaugguuggaaaccaaaggaguggagagauuaaaaagaauggccaucagcggagaugauugcgugguaaaaccgauugaugacagguuugccaaugcccugcuugcucugaacgacaugggaaagguuaggaaggacauaccucaauggcagccaucaaagggguggcaugauuggcaacaggucccuuucugcucccaccacuuucaugaacugaucaugaaagauggaagaaaguuggugguccccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7674 - RNA, 9873 nt, Artificial Sequence
  derived and/or modified CDS sequence (wt) from DENV-3__FJ432722__SS-prME
acaucgcucugccucaugaugauguuaccagcaacacuugcuuuccacuugacuucacgcgauggagagccgcgcaugaucguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacauggguaacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggagugggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacucagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcauacaggagaccaacaccaagugggaaaugacacgcagggagucacgguugagauaacaccccaggcaucaaccguugaagccguccugccugaguauggaacccuugggcuagaaugcucaccacggacaggcuuggauuucaaugaaaugauuuuauugacaaugaaaaacaaagccuggaugguacauaggcaaugguucuuugaccuaccucuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcguugacaggagcuacagagauucaaaacucaggagguacaagcauuuuugcggggcacuugaaaugcagacuuaagauggauaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacauguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuacgucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccagguggggguuggagugcagaaagaaggagucuuccacaccauguggcacgucacaagaggggcaguauugacgcacaaugggaaaagacuggaaccaaacugggccagugugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccaacaccggaauuggaagaagaaauguucaaaaagcgaaauuuaaccauaauggaucuucauccugggucaggaaagacgcggaaauaucuuccagccaucguuagagaagcaaucaagagacguuugagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuacagacuuuguuggaaagacggugugguuuguaccuagcaucaaagccggaaaugacauagcaaacugccugcggaaaaaugggaaaaaggucauccaacuuaguagaaagacuuuugauacagaauaucaaaagaccaaacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucuauuugaaccagagagggagaagucagccgcuauagacggugaauaccgccugaagggugaguccaggaagaccuucguggaacucaugaggaggggagaccucccaguuuggcuagcccacaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuagaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccaggcguuguuucuccaaccagcuauuuagauguagacuugcacccagcaucagccuggacauuguacgccguggccacaacaguaauaacaccaauguugagacauaccauagagaauuccacagcaaauguaucccuggcagccauagcuaaccaggcagugguccugauggguuuagacaaaggauggccaauaucgaaaauggaccuagguguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaccaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguacccauguccacauacggauggaauauagucaagcuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaaaaaacaaccaguuuugcauuaaaguauuaaacccuuacaugccaacugugauugagcacuuagaaagauuacaaagaaaguauggaggaaugcuugugagaaacccacucucacgaaacuccacgcaugaaauguacuggauauccaaugguacuggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuuuaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugagaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguacaacgaccaacuccaaaaggcacgguaauggacaucauaucuagaaaagaccaaagaggcaguggacagguggggacuuauggucugaauacauucaccaacauggaagcccaguuagucagacagauggaaggagaaggcguguugucgaaggcagaccucgagaacccccaucugcuagagaagaaaaucacacaaugguuggaaaccaaaggaguggagagauuaaaaagaauggccaucagcggagaugauugcguggugaaaccgauugaugacagguucgccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguccccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagucauuugguaa

SEQ ID NO: 7675 - RNA, 9873 nt, Artificial Sequence
  derived and/or modified CDS sequence (wt) from DENV-3__FJ432728__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuccuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguagucaucacagaagacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaauacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagauaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauugaacccuuacaugccaacuguaauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggacuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagguuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7676 - RNA, 9873 nt, Artificial Sequence
  derived and/or modified CDS sequence (wt) from DENV-3__FJ432731__SS-prME
acaucgcucugccucaugaugauguuaccagcaacacuugcuuuccaucugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuagacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucauguuugugcuccuucucucagggcaaauaacauggagagauauggcacagacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccaugacaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcuuuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagacccagguggcuugaugcccgcacuuauucagaucccuuagcacucaaggaauucaaggauuuugcagcuggcagaaagucaaucgcccuugaucuugugacagaaauaggaagagugccuucacauuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaauccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcaguggucuugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagccgggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauaggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaaggguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuaggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggauaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuuuugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7677 - RNA, 9873 nt, Artificial Sequence
  derived and/or modified CDS sequence (wt) from DENV-3__FJ562097__SS-prME
acaucgcucugccucaugaugauguuaccagcaacacuugcuuuccacuugacuucacgcgauggagagccgcgcaugaucguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaaguggucauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaaggugcccuacccagggggaagcgauucuaccugaggagcaggaccagaacuacguguguaagcauacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcauacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggauaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuggagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucaugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcagcaacguuacaacugccagaggacauugaacaaauggcgaauggaauugcucuggggcucaugacucuaaaacugauaacacaauuugagacauaucaguuguggacagcauuagucuccuuaacauguucaaacacaauuuucacgcugacuguugccuggagaacagccaccuugauucuggccggaguuucgcuuuugccacugugccagucuucgagcaugaggaaaacagauuggcucccaaugacuguagcagcuaugggaguuccacccuuaccacuuuuuaucuucagcuugaaggacacaccaaaaaggaggagcuggccacugaaugagggggugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcgucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggccagugugaaaaaagaucugauuucauacggaggaggauggagauugagcgcacaauggcaaaaaggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaauggugguuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucguuagagaagcaaucaagagacguuugagaacucuaauuuuggcaccaacaagagugguugcagcugagauggaagaagcacugaaaggacucccaauaagguaucaaacaacugcaacaaaaucugaacacacaggaagggagaucguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacaccccccggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagccggaaaugacauagcaaacugccugcggaaaaaugggaaaaaggucauccaacuuaguagaaagacuuuugauacagaauaucaaaagaccaaacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucuauuugaaccagagagggagaagucagccgcuauagacggugaauaccgccugaagggugaguccaggaagaccuucguggaacucaugaggaggggagaccucccaguuuggcuagcccacaaaguagccucagaagggaucaaauacacagacagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugauguugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccaggcguuguuucuccaaccagcuauuuagauguagacuugcacccagcaucagccuggacauuguacgccguggccacaacaguaauaacaccaauguugagacauaccauagagaauuccacagcaaauguaucccuggcagccauagcuaaccaggcagugguccugauggguuuagacaaaggauggccaauaucgaaaauggaucuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguugucccggaaagaguuugaccuuuacaagaaaucuggaauuacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugugcaggacugaaaaaaguuacagaagugcgaggauacacaaaagguggcccaggacacgaagaaccaguacccauguccacauacggauggaauauagucaagcuaaugaguggaaaggacguguuuuaucuuccaccugaaaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguacuggcaacaucgucucuucagucaacaugguauccagauugcuacuaaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguacaacgaccaacuccaaaaggcacgguaauggacaucauaucuagaaaagaccaaagaggcaguggacagguggggacuuauggucugaacacauucaccaacauggaagcccaguuagucagacagauggaaggagaaggcguguugucgaaggcagaccucgagaacccccaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguccccugcagaccccaggacgaacuaauaggaagggcgagaauuucucaaggagcaggauggagccuuaaagaaaccgcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa
